United States Patent 10,233,495 (METHODS AND COMPOSITIONS FOR SCREENING AND TREATING DEVELOPMENTAL DISORDERS) - sequence listing, part 152

SEQ ID NO: 802 - DNA, 1633948 bp, Homo sapiens
  misc_feature (90903)..(190902): n is a, c, g, or t
tgatttaaaacacaaattatttgcttatttttcacactaataacaaagaatatagacactatatatgttccaatcacattgatcatgcagaaaataaatattctttggtactggttttcctttgatcacaaatagatatgagggcaaaatgtcttatcacttatttacaaataactgatggccaaaatggataattgtcatgatagaagttattgacactggctgggtggggtggctcatgcttgtaatcctagcactttgggagaccgagaaaggtgggatcacctgaggtcaggagtttgagaccagcctggccaacatgtagaaaccctgtctctacataaaaaaaaataaaaaataaataaacactctttggttttggtggtgggcacctgtaattccagttactttgggaggctgaggcaggaaagaagttattgatacaaatatttgcaaaaataaaaagttatttgatacccacaaataattccaaagtatgtccatgtgctaatttgtaaataggaaggaagttcttattttgaaacttgcagcctggaaaatatttataaggttgttatgacattgataactggagtacttcctatatcaacttactagaattttggagactgactttaaaatataataaaaagggaaagacagggaattgaacttccttctcatgttttttacaaattttacagggagccagtctcatttatgtaatcacagatttattttacaagtttggacttgcaaaaatatgccaaaatttgaatgccttacccatttttttgggaagcagctaaaatatgtaatgcactgaccttttaatgttcactttgattggttaatggttacacctttacagctcagtcagattgtaaacaaggggacaaaactgaatatataaggtcagagaagtatagtgacaaaatttatgaacccctatacatttcctatgaataaaaaatgattaaaattcatacgtttgctttttaaatatatacataagaaacatcaaaaattaattcaaagcatatattagcaaatatattcttaattttgtcttgaataaccttctttaggtgtgcctttttctacaaagttatgtcttcattaaacatttttcaaattattagtattattatttttaactgatgcttcatattttatttcccctctgctctcccatcccacctttggtgatggttgtgcccatctgagcatttcggggcacatgaccgtaagtaaatcttgagagaggagtggaattattgtctaaacactaacagaaggggattacctgtaaggatagcataactgttgtgcaggaacagaagctgcccagatcttcttggtggagagtgcatagaaaaaagacttagaattatggaacatctgtccccccaaccaccctttcccacccatcccccaaacccccactcccaccctattccccgcccaattaatagtgttaacaaaaggttaatctaacttttttttttttttttgacggagtcttgctcagtcgcccaggctggagtgcagtggcgcgatctcagctcactgcaagctccacctcccgggttcacgccattctcctgcctcagcctcccaagtagctgagactgcaggcgcccgccacgacgcccaactaattttttgtattttttagtacagacggggtttcaccgtgttagccaggatggtctccatctcctgaccttgtgatccgcccgcctcggcctcccaaagtgctgggattacaggcgtgagccaccgcgcccggcttccagaatataaaaaatgagttccatgacgacagggccctcactgagctggcaggcccctccatggatcaccggcaccaaggcgctgtccaaatcattcatggactgcgagggaaggggctggccgctgctccctgcttgatagccagcctgatctgagtcaagtgttacacgtagtcccagtttggtcattccatcctccttcagaagcttcaggagcaaggcaaaaagccttggcaacatgctcagtcaatctactgtgatccgtaggatcactgaggcaattgtgccggtcatcgtttccttgtaatcccagcactaggatttctaggaaatcctgggaatcgttttctagaaaaaacacctctgtccatatgatgacttttccatttgctttgtattctgatccgtggaatatcttcacatttgttatagtctccatggacttcccatctataggacttagacacccttgctaacgttcttgtcatcatccacccaccggatgtgcatgcgctcctggggatcctccgcgtctgccttcccacaggtgatgctgaagtccctcgtctctagcagtgcctgcctcgaggaatccatgttctctgcagtgatctggaccataacgccatcttccacaatactggacttggcaaggtatccagaagaggatttcagagcgccaccgaacacaaaaaaactgctttgagtttgcatatagttacagtagtactgaaaaatcctcgcaatttaggtttttgttttcagttttctctgttttctagtgcataatgacttaataaatattcatttaacaaaaattgaaatctcaaaggtacatataaataaacaatataaataaccatccttattacagttaactttgtgctttaaaaaaaaaaggcatccaaagaaagacagacgtattcatgcaataaaatcttagcaatccctgcaatagtttaacagaattatcagccctcccatcttagtctggacagaatgaaaaaaaaattagttctctcgtgttattctttgagctccaactaggaaaaattactgaaaacagctggacgttacaactgttttgggcagagaagtcacactgttcaggaggaccccatggtagaaactgttttaaaaaagttctttttacttgaaattacacaagaaagcagaaaatgacattgcaaaaaggaaaaaagtataggcaggaacattgttacagaagccaggtgacaatgagaagtagagagtagaaagcaatcaacccttttgaccactgagaatgaggatagtagaaattcaatggctcatggatagcaatagtcactcacatgtcaataacagggattctgaagagtcagacttatgcatacacagagcatctctaccacatgcatgaattatgtgtgagtttggtgataatgaagagagacaaactgctgcatcaactaatatactctgggagtgaagagcaggataaaaaaaaaactgtagagaccactactctaggtcatttaagtattttaaggagaaaaaaataacataatagaagaaagtgataactatctggagtggtgggatgggtggcttctgacacagctcccatgtttctgattccacctcccgatatcttgtattatctccccttcttgagtatgagctggacctggtgccttgctggtaagagacagaattcaacaaaagtaatgcggtgttacttccttggttagctaacaaggaactatgtcttgccccttgctagccacccccaactcttgctggcattccctcttgccctctcgcttgcttgctttgataaagagagttgccatgttgtgtgatgctttgtggagagacccacgtgacaaggaaccaagggagtttacagcacaacacctggcacaaaactaaagccaacaactatgtgagtgagtctgcaaataaatcattccctgtccagccttaagatgactgcagacttttaaaagagtgagagtcagaggccacagctaatccacatgtggattcccaccaacaaaaattgaaataatgtgtgttttaaaatgctaagtttgggggtgatatgttacatataaatagataaataataaagatggtttggcatggagataatgacagaaaggaattcgactattttaatagtccaatgaagaggtatgaaagatctgaatttggatggtagcagtgtgaatgatgtaaaagataaatgtgagattctataaggtaagattttataggacctaccaataataggggtgagaggaggatagagagatgggagagagaaagggagggggaaagagagaaaaggagagggagaagtggtaaatgaacaagatttttagttcaagtcagtaggaaaaccactggcagagttgttttatttaagcattaacaattactttccgagcaactgtgatgtgtaagacattatgttatctgtactagacactgagatgaaccctcaaaatggtgatgccctcaaaatggtatagtgcaaagtagaatgttgtgaaatttttcctaatggagaaattcatccaattagcatttgaggaaaggtatatgtgagttggactttggatagtaacatacagagattagcattagaaaggaagcaaaatatttcattagacatataaagaagtcaatagtttattttcactagattgcaagcatatgaaaaagacaacaggaaaatgtgtctcaattgtcagcctaaatttaacatcttattctgtagtgaaatcacaggacaagtaaatagatgtcttgcacttaggacaaattatttaagtttgttgaagaaatgagatgattgattttatttttaagtaataagtaatgtgagaacatctgcaatcagtaagatttatgtagatccaggctcaacaaactactgccgatgggccaaatctagtctgcagctcattcatgtaaacaaagtttcactggaatatagccgtcctcattcattacgtaatgtctatggctttgacagagactgtgccacctgcaaagtcaaaaatatttactatctgtccctggacaggaaacgcttctcaatccctggtctacatcataaaatggatttgagtggagagaaagaaaaaaaactcattaaaacatatggggtgttactgccttaaacaagtagtatactaacaatagaaatggaaaggaaaagttggagtgtgcatgtgggtatgcatctgtgtgcatttgtgtgtatgtgatgaaaactgtttaaatgcagggtacaatatagaagaggaggccatcgtggtgcttagatggctctgaattgacagtctcctccgttaatatttaagtgcaattttggaggaataagtctttccactcaactcttaagtggtttaatcaactggccatatttttttcctaatggttagaaaggataagttactcagaaggaaaagtagtactgattgagaaagaattataatggaaggtggggggtgattgcatacttctaggaaagctggagggaacagctaaaaaacagtatgatactgaacacttggatgaaagcatgagtgaaagcaggtgagagcagccctaaaaggacgccagtttgcaccaaaagtaaacactggttttcatgctgcctcttgtatatatgtatcaaaagatactggtacttaatgtataaattagaatattaacttttaaaatatgaattgaacttatatggggtttaaaaaaatcaattatttaaaaacatcaccaggttccttttgttgtttaaattctctcctgatagaactaaataggggtctcttaaacagggttcaagaagcagaaacatacataatggtactcaggattcaatgcattaaagattaatattccttgaattagaagagccgaactaagtatccaaacaccagatataggtctagaatagcagatacatctaagtaggtttcaactgtctaagggcacatgcctggtgcagggacatgaacaaattgtgagtaaacagggataaaagccctatgagggatgtttaacattgaaatgtataaagtttttatttaatcacaaagttttctatattggctaaaattttataatgataatgaattattcatgtgaaaattaaaaactgttttttttgtatttttaaagaaaaaagcacaaatacacccatagaacactgtgaaatattatctttcacaatgtacaccaggccaggaaattattgggctaatttgagtcttcaacaaaattttactttgtgaagaaataagacaatgctggagggaccaaggttttcatttgcctgtgctccttctgatgccatctttactctccaggtgaaaggatgtttctgagatcaatattcctctcctttgatagttaccttcttttaaaacctactgaacactgacttactcagctccactctattcttccccgtttcctctgggtcctttgataatagatgctggtatccctgtctgtcattcactcctatatggttctcaggatttgtttgctgttcctccctctgttaacctgagccttgcgggccaaagtaaattactctcccagcaccttttatacagagtggtccatagtagttttcctgacacctatgttattacacatttctctccaagaacatctctaaagctttatgatttatacatttgagttaccttagaccaattgacctaaacacaagatatgctgtcacattttaagctgcttcctcagaatatgttggttgaaatctactgcctctcccttgtccagggtttctaaatacccgtagggtagcttctcaataatatatattactaatagctcagaatgattattatactaacaagaactttttactttcattactgtgtcagaggactcggaatatcattagcaaaacctgtttagaacagccatcttaaatccttgttgaaccaattccagcatgcttttaatttaagtaatcctggcgccgtggctcatgcctgtaatccaatcactttgggaggccgaggcaggcagatcatgaggtcaggagatccagaccttcctggccaacatggtgaaaccccatctctactaaaaatacaaaaatagttgggcatggtggcatgtgcctgtaatcccagctactcaagaggctgaggcaggtgaatctcttgaacccaggaggcagaggttgcagtgagctgagatcgcgccactgcactccagcctggtgacagagtgagaccccatctcaaaaaaaaaaaaaaaaaaaaaaaagaaatcttgagtagtacattccttcccaagatgagcatgcaaacaaagataacatgactttttattctatatgtacgtttgaaagatctctttagtcctttaaaaacttcatgagatgtataattttataaatattgagatgctttgggaaaaatattgaagaaaggccatttgattaggcataaagcacttaaagtgaatgccaagaaagttgcataggtcaaaataggtccacaaaaatgtatagattaatgaaccttccaatgtgaactgactgtttctctgagtgtcttttataattatgggtgaaggctgaggattgggcctggcccagatatggattaggggtaaaataagcagtggcacacaaaagatattttccctgaggcatattgactgaattattgtgatatatgcaagaatgaggagttattccagaagatttcaagagacagaataaaatcttcaagagtatcacagcaactgggagacaaactcattgcaaagaagagagcctgccccaaaagcatggccaactcccttgttcaacacatttctaagattttgaagctgaatagggtgaaatgctaaagggctaagcccaatacccctgaaattaaaatttaatctccaacaacattttttgagactaatgagaagtagttcctaccagctctcaatcaaaagctcaaaaggaacatacttcagaaacagagataagccaaagatgccagtcttactgaaactaaaactgaatcctgactgctccaatatctgattgtattggtaatgactttctcccaacactatctgcttaatagagaaaagtgggaatacattctaaaactactattaccagaatactttattattcttttatacacaatgtccagcatgatacaaaaaacgtctagatatgtgaagtggcaaaaattgtattaatcaaaacacatgtgcacaataagcgcagctcactgattcacagttcagaatttagcagacaaatttagaatgaccgttgctaatataataaaagtaggcaaactggatgaaatgatggagattgcagcaaagatttaaatatctataaaaagtcacacagatattctaaaacagaaacataataattgaacttatgtcactgaataggcttgctttagaataaatgtagtaaaacaagttaacctgaaaagagattcatagaaataatataaattgatctatagaaataatctcaactgaagagatttaataaagcagaacaaaaaagacataaggcactgtcacaacatctactataactaaactggacataaagacaagtgagagagaatggagaagaagcaatatcggaagagccgttggtcaaaaattttgtaaaattgataaagaatatcaacctacttgcaagaaacttaacaaaacctaaggaatataatacaaataaaactttacctatgcagattataagctgctgaaccaaaacaaaactctcaaaagtaagtaaaagagcacaaataagtattccaacaaaaacaatagaagctggagacaatgaaatggcattttaacatgctgaggggcaaatttgccagtctaaaatttaataaccagtgaaaaagcacataaaagtgaagcgcagtaaaatatattcagacaagtaattgttgagagaatgtttgcctaggagaactgaactacagaaatactaaggaaagttcttcagactaagaaaaaattatcccagagagaagcatacaattagaggaagcaatgaaattaactgaaataaaagccttaaaatattggcacaagaagttctaaagatctgagtaagttctgtatgtattatagaaactacatttatgattaacacattttacacacacacacacacacaattccaaccacatgtggattacctggtgaatccttaccaaaacttaaggaactaattgaactagtcttacacaagcattttcaggaaataatacaaaagaaagaacactttaatttttttgtgggaagccagtaatcattgatacaaaaatctgaaagatattaaagaaaagtaatttataaagaatattcaccatgaaaataaacctgagaagtaaggataaatataattaacttgtcttttacaaagtttaaatgttgaataaaatatatgacaaagagtgggagtagctaaatagtgttcaactgctctaaggtccttacattgttggagaagtggaaaaagtacgaacatacttcagaaatagtagtccacaatagttgagaataaatattatatcctctaggataactaaggtacttaaggtagtccacaatagtctagaataaatattctgtaggataactaaaagtactaaaaaggaattacaagtattttaataaaatgaaaaataaataattattctaaaaatggaaaaaaggccaggcgaagtggctcctgcctgtaatcccagcactttgggagtccgaggcgggtggatcacaaggtcaggagttccagaccagcctgaccaacatggtgaaaccccatctctactaaaaaatacaaaaattagccaggcgtggtggcgcatgcctgtaatctcagctactcaggaggctgaggcaggagaatcacttgaacccaagaggcggaggctgcagtgagctgagatggcaccactgcactccagcaggggcaacagagcgattaaaaaaaaaaaagccaaaaaaggaaataagaataaaaaaagatagtacaaatataaaaatattaaatccagaatttgaaagattaaatccagaattttaatacagaagattgtttcagaagattgtttcagaagatgtggaataactaccactcttatagactgttgtgtgaatgtgaatctgaacaaccatcttgaaaattcttttggcgagatctactgaagttaaatgtttgcataccttttgacccagcaattccactcctgggtatatatactcaagatcaatgagtacttcagtctaacaaaagatatatataagatattcaattagcattatttatagtagcccaaaattagaaacagatgaatcatccaataacacagttatatattcataaaatggaatacccctattaaaattataaagtatgaactataggtatatacaagaatctcataaattttgaaaacctaatattgaataaaatcagccatatgcaggagcatatatactgcatgatactatttttatgaagctcattaacagcctattaacattaattcattaatggaatgaatctatataaatagaggtcagtataggagttatctttttttgggttgtagttgactgagttggcaagaagaaggtttatggggtatttgtaagatttttttttttttggaggtggagtctctctctcgtcacccaggctggagtgcagtggcacaatctgggttcactgcaacctctgtctcctgggttcaagcaattcttctatctcagcctcccaagtagctgggattacaggtgcccgccaccacacccagctaatttttgcatttttagtagagacggggtttcatcaggctggccaggctggtcttgaactcctaaactcaggtgatccacccgcctcggcctcccaaagtgctggaattacaggcatgagccaccgcgcccggcctgtaagatattttttatctgagttgttccgtgtatgaagctatgtgaaaattcaatgaggtgtatacttaagatctgtacactctgttatgtgtaaattatacattaatatttaaaagaaaaataagtagattaataaagcacagtttggttttacagatacctatctatgacccaaccattctacatttaagtatatacccaacagatatgactgggaattttttacaccaaaagactttcattataatattatttttatatgcagacactcaaaacagttcaattgtccaccaacagcagaatgtaaaaatattttatggatcattgatagagtggaataaaatacagcaattaaagaactgctgctacatctgtggtgtcacaaatatgcctgcattcatagaaatttcctcaggaaaaatgaatctattgtagaggaagtcagaaaagtgttctattcggtagaagaaaattaatgaggcatgaaagaggcttctgaggtgctcttgtttatggtggtcacatgactgagtccatattgaaagattataaaaattgtacacttatgattgatgcactttttagtctataacaatgtattcatttgcaggagctactctccaaggtaccacaaaccgggtggcttaaaacaactcacatttattgtgtcacggtttgggaagctagaaggctgaaaacaagatgtagtcaaggtagtttcctccagaaggatataagggaggctgtctgtgtctcttgcatctctcccaggatctggtggtttgttggaaatcactggtgtttctgagtttacagatgtgtcagcccagtcttccatatagtgtctgcatatagtcttccctctgtgcatgttccccttgtgttcaattttcccctttttataagaacactagtaatattggattagtacccaccctaatgaccccattttaactagataacctctgtaaagactctatttctatataaggtcacattctaaagtattgggggttagggcattagcatatattttcgggaaaaacacagttcaacccatagcaacatataattccatttttaaaatcccaaaattacatctagcctaaaaaggaatgaaattgaaataaagatcgcagaggcctgcagtaagccttgatgatgtaatacctgtttataaaccaaatgttagaatggcttgaaacagaattgaacatttttgcgctataagacacataggagaaattttaagtactttttttggatgagacattagtctcaacaagactgaatgattttcttttaaggtcacacatttaaatagttaacaggagaaatagcgaccagaatcatagtcaaatacccacctaccccctttccaagacaactaaggtctcaaattgcgcccatttttctcaaattatttctagaatgtttagcaaaagaggcttttaatttggcatatctttgtctacagttttgtagtttatgtaaagaaaggtagactaagggaatttcattttaaaggtgagaatcagaatgacatttgtgaagctatgatgcctgtgccatctggcatacacgagggtgttgtactaaatgggatcagaatgagctccttttggaaggaaacctttaatagactgggaaacattaagggaatcttccctttttatttttatttaattttctttctttctttctttctttctttttttttttttttttttttgagatggagtctcgctctgtcacccaggctggagtgcagtggcgtgatctcgactcactgtaagctccgcctcctgggttcacgcctttctcctgtctcagcctcccgagtagctggggctacaggcgcccaccaccacgcccggctaattttttgtatttttagtagagatggggttttacagtgttagccaggatggtctcgatctcctgaccttgtgatccgcccgcctcagcctcccaaagtgctgggattacaagcgagagccaccatgcccggccttttatttttaatagagcattggaaaatgaattctgcatagctagctaatgaaggaaatccagagtcattgccaaaaccgagttttaaaggaatttgcaatccttcacagttcattcaaggaggcaatggaaattttgaagaagaatttttttaaaatctttcttaaaaggagcccttacattggcattgtatcacgactaaagtcttgctccctccctctctcccttctatgctttttgtttctcttttctatctttcaatgacatcagtttcatggagataaatggttaaaagataatgattacaacacatacagttgagtgacacaaatcttgttgtagtgttagaaatacatcaatacattgggatcataaagataaatggcaagaaaaaaaatctaagttaataacagaaaatgctgattcccacagtccgtgtagaaaatacacgttttttcctgtcagtggagataactgagaccagttaatattgtcaattctgttccttctgactgagccaggtgaggcaaaatttagcagatgacttgagggacaaaactatgaccttggcaacataaaaattaatactgtctacattgtttactaggaaatgcatgcaaaattaatacactcttggtagtacaggttggtttcacttctatagtgtgtagttactagaaagctgattcaacagatgatagattcaacagacgacatagaattgtctaaaatccagccgggcgcagggcctcacgcctgtactcccagcactttgggaggccgaggagggcagatcacaatgttaggagatcgagaccatcctggctaacatggtgaaaccccgtctctactaaaaatacaaaaaaattagccaggagtggtggtgggtgtctgtagccccagacactcggaaggctgaggcagaagaatggcgtgaacccgggaagcggagcttgcagtagtgagcggagatcgcgccactgcactccggcctgggcgacagtgcgagactccagctaaaaaaaaaaaaaaaaaaaagaattgcctgaaattcatcttcaattagtccatggcatgttttggaatttattcacttgtttgcctcaggaacagtagctgttcagatttgttctttgattttggaaatgaggttaccgtgctctgtagtgtcaggaagatgacgtggcataatcaggcaaacggctaggcattttctcagcagtaaattaccagtgcccttgcttgccataatacccacaaaaggcagaggcagtttcctgaggcaatccaggccacaaagaactgtacatttggggaaaacgtatcttcaaatatatatgttaaaatctaaaaaattggttagtatgtattacttttgtggatatttaaacattccctatgcataaagacctagttaaagaggtgcaggcatttggcatgttaaataactccttgatgagaaaccacactatgaataataaatatgacttaataaaaatgaaaaataatgagattagtttctattgaactattcttgcttagaatgcccctgaatttcagtcatagaaattcacttgtacctgggtaagttacaagtacttatttgtgctggtttctgtgtcattggcaattaaaattttggtaagttgaataaaagatctttctaaaaagggagttcttttttttttcttttttgagggggacggagtctcgctctgtcgcccaggctggagtgcagtggcgcgatctcggctcaccgcaaactccacctcccgggtccatgccattctcctgcctcagcctcccgagtagctgggactaccggcgcccgccaccacgcccggctaatttttttttgtatttttagtagagactgggtttcaccgtgttagccaggatggtctccatcttctgacctcgtgatccgccctcctccgccttccaacgtgctgggattacaggtgtgagccaccgcgcccggccaaaagggagttcttacactggcaatgtatcatgattaacgttttcctccctctttctctccctcccacatatgtattttcgtgtcagtatatgtatatgtgatttgtgccatttgtgtgtgtgtaggtaaatgaaagtggcatcaagaaaatctcacattaaaaaaatttgagatagtacaattcttatgcatcatatgttgcataatgtttgactattaagaaatttgcatcacacgtctacttatttcattaaacatgttacaggcaattaatttacttacaccctccatttcttttttcccactctctgggtctcctgctgcagggtcattatatgttccactcacaaaatgtccttgtttttcccttactcctgtcattgatcttctgaatctttctggtgaatttagcatggatgttttgatagaaagctctggcattaactctggagttgttttgcaaggaagattgttctctttttcaccattttttttttaggtccttgaagtgttttcacatagatatttcacaagagccatttcagaactgagaacattcggcgtgcacttttcctcttttggtcccacagtttttatgagtcctacttgaaattatgtttgctcccgtttcaattgtaatattgcacttactcattagtttttagtttgaactctcctgggaggtctaatgtagagtttggacaaagacacagattcataataaacctacccagtcaatttggtataaaggcttagaaggtggaactggccacattttgaattggaggtaagtatcaggaatggtaatggagagacatacaggattttcttatgggaacaagaaacaacctctgggcagtattagagcccagagagtgaaaagcctcttctaacttcaatattctatgtacaaatttacaagacttttttttttctttttttttgagacggagtctcactcagtatcccaggccggagtgcaatggtgcgatctcagctcactgcaagctccgcctcccgggttcacgccattctcctgcctcagcctcgcgagtagctgggactacaggcgcctgccacacccggctaatttttgtatttttagtagagactgggtttcaccgtgttagccaggatggtctccatctcctgacctcgtgagccaccgcgcccggctgagacttttaattgacagactgcattgcataagccaaaggccaacagagaggtgacctttcaaattactggcacaacaggagccgagatcagaaagctccaacttaatgcaaacatcgacaagaaatccgacagaaatgacttctgtgtctggtcaacttaacataacatgacatattgtcaagcgcattttgctttttaggtagaattgtctataacgatttaactgctttagaaaatataaatgtgaagatttgtggtattcgggtttatatataagatatttctacatttaaaagagacagagtggaaaagcttgatataagatttgtaaaatatgtttgtaataatgctaatggaagaggtgagagttgggtggggtggggtgtagatgggaacatggtttggggattggggaaagggaagtcatgctgttaataaaatagtgaggcatgttgtataaagtgtgttttatgtctcaattgaaatgttatagagagaaatttaaaatagatcatgattggttttgaatctgatttctaattttaaaatgttatgagcttttgttgctttcctatttcatacacatttctttatgggtttcacttagactgcatgaaattgcagatgccaattaccttttaataaaattaaattcacatatatgtataatttgcatgtatatattcacggaattttttattctatacgtgatatattattttaaaatggtttatcaatgacataacgtataatttttctatactttcagttttctggtttggattttttctggcaacactaattttcacctacctatactcattgatagtataaagttgtacaagtgcatatttgaccatgattacagttgaatagatgactggaggtacatctatgatgactaatactttctaaacacatatttacctctcatatatctgtgtaaatgattgtaagaggaaggggaaaatagagatgtatcattaggtatactgtcttaaagcacattcagctgctctcatgtttggagaattttgaatgtgatgaatgtttctctttcaccgctaacaggttgtgtgtgtgagccagattttattgcaagtgtttgaaagactattgcaaatatcggatattgccagacagttggtaaaaagcaaattgagtctattgagaaattaattcaccagctgaaggaagcacatttgccttacagtcatcagatattctacccaccagactcatctccgagatagcatcctaatgagcttcctaaaccaactaaacatgagcaggaagcatcagtcgtcaaaactgactcttttcagccaatcagctgactgcacaaactgtatggcattgaggaaaggaagaacattctgaaagtttttttttttcattctgccctcactttgttggtttctcagttttacagatgcagtgtcatgcgcagaaccctgtaaatgagcatagttcattcaagtatataaagtgctttcgtgtattattattcagtggaataaaatgaatgttaacaggcttaagtgattttcctaaaggcacacaattaatgtatggctggaattcaaaatcgggtcttttcctctgttctgattgttctataaataggggtgtagtgattgattttctacccaccatgacagggaataggttcaaaacttaaaaccctgttcattttataattaggtagactcaaatgacaggtcaaggcagggaggggagccagtcatttttattcccatatgggtttgctccttcaaagacaggattggggtagcagggtcagttcctacaggttataacgatcttaatgataaagttaactaaccataactgaatagtcataatgtgctagcacttttcataatgtatcccaaataatactcacaaaaccttccaaataaatgttacctttttgttatctttgttttattttgtttgagacagggtttcagtctgctgcccaggctttagtgcagtgatgcaatcatggttcactgcagcgtcaaactcctgggctcaagcaatcctcccacctcagcctcccaagaagctaagactacaggcatgcaccaccactcccagctccaaataaatattcttatcccattttactgatgcagaaaaacgtatggcccagagaagtaatgttaagtttattgggggatttaagttgtaaaaaattattttatcgaaccctaatgtaaactatggactctgggtgatagtgatgcgtcagtgtaggttcatcgattatagcaaatgcatcattctggtgcaggatgttgacagtgggggaagctgtgtgtgtaagggagtagggagtctaggggaactcttctactttccactcaattttgctgtgagtctaaaactactctaaaaaatgaagcttattaatcaaaaaaaattcttatattttatgaatatatgggacagctattcatgtatgtggtaaaaagagatttgttacaatactcggcaggagtgtgtctaatatgactgatattcatgtgtcacttataaaaactggcttcataatctgtagattcatttcatttgtgtatgttcgcttaagggcgcacacatggaaacactttggtgttattaaaggtctgttgggagggctcctctttggtggaagctatgtctatttcttaaaagtgatttaagagtaagatgtgaaatagcacttgcccccgaggatggagccaacagagcataggggagttatgtgatgctatctctgagagactggagagaggaatataaaaagcttattccttaaaaaagaataggggaggacttccttacctgatatctcagattatgaagctacagttctctccctgctttagggaaaaataataataacatactttttgcaaaaatcaattactgaacatattcctatattttagatttataatgaagcatttttgtacatattcattaaaaaagagtaattaaaatatttttctctggtttatagtaactaggatggcaacacagatatatcttggaagtatttcttgggatgattcttcaacataaaactattcttaaaaacttcttagaagtctccaggtactcaggaataaggtcattttaaattattccttattgaccataagaaaaataattaggcaagaccacaaaactaaatgtttagactgtttctcctgtttcctgattttcaggttatttttttatcccaattttattttgctgtatggtcatacatttcatctttgaaataaagtatataataatcacttttttttttttttttgagacagagtctcgctctgtcgcccaggctggagtgcagtggcacgatctccgctcactgcaagctccgcctcccgggttcatgccattctcctgcctcagcctccccagtagctgggactacaggcgcctgccaccatgtccggctaattttttgtattttttttttttttttttttagtagagacggggtttcaccgtgttagccaggatggcctcgatctcctgacctcgtgattttcaaagctgttcgagggcatttatcaggcttttaactctaggtactctttcccgcagtgtgacggccaagagaagggatcctgggctctcttccctggccccaggacgggaattcagggggaaaattcacctactcttatcccacaaaagaaaacttattcatcagttgtcaagctaaggagcttcagagtccataaagagggaaattgctaagagcttatcagtagtgtccaccccgcatccccacctggggtcacatggagaatgatggtgggggcaccgatcttgtcctgcttcaggtgaaaagcaggggtgtgggggggtttcattgtgaagggctcctttgttaaaattccttccaattccaggaaaaacatgcactccaaaagccattatctcttttactttgtactaggggacttccaggaaagagagagaggagaaagaagagggcaaaacaactgcagtgaatttagtcacctctccaattgcctttcttgttgcagaatatttcacattccaggaatttccttcttgacctctggactgttgatacacccaagatcttaatatgctttcaatcataggttaaagacatcaagcgccagatcgcttgggcctaggagttccagaccggcctggacagaatagtgaaacccagtcacattttttttttaagggggagatttgctcttgttgcccaggctggagtgcagtggcgaggtctcggcttgtgggacctctgcctcccgggtttggatggttctcctgccacagcctcccgagtggctgggattgtgtgagccaccatgcccaactaattccctaactgtgcaactgcaaggtcactaaacaaactcgtcacaaaacatatttttccttaaatagtaaaaaataatataatgtatgtttcaattaaataagtatctttgtttctcgcttctataatatgcttctccctgcacagatctcccccttcgccccacataatgcttgaaaggtaactcttggttcagtactcaatcctttaaatgttaatccgactgggctggtgcacctaaataattaataaatgtcctcctaaaccccatgagtctatctaattccttaaaaatccctctacaggactgcaggtgtgagccaccgcaccccgcccaatttattaatcagagaggaatagatgggcctggcttggtggcttgcgcttgtgatccaaggactttggatggcagagcactggggatcatttgagcctaggagatccagacaggcctgggcaacatggtgaaactcggtctctttttttttttttgaggcggagtttcgctcttgttgcccaggctggagtgcagtggtgcagtctcggctccccgccgcctccgcctcttgggtttgggtggttcttctgcctcaacctccctaatggctgagattgcaggtgtgagccaccatgcctaattttcttttttctttttttttttttttggtacacacagggtttctacctgttggtcaggctggtctcaaactcaggacctcaggttatccgcccgccttggcttccgggggtgctgggattgcaggcgtgagccagcacgcaaagcccaactaattaatcagaaaggaatagatcggcctggcgtggtggctcacgcttgtggtcccaggacgtcggacggccgagcgcgggggatcgatcacttgagcctaggagttccacaccggcctgggcaacatggtgaaacccggtctctcttctcttttttttttggtacagacagggtttctccatgttcatcaggctggtctcaaactcccgacctcaggttatccgcccgcctcctgggcctccgggggtgctgggattgcaggcgtgagccagcgcgcccagcccagtttattaatcagaaaggaatagatcggccttgcatggtggctcacgcttatgatcccaggaatttggacggctgagcgcggcggatcgcttgagcgtaggagttcgttctatacttgcctgggcaacatggtgaaacccggtcactttttgtttgttttgaggcggagattcgcttttgttgcccaggctggagtgcagtggtgaggtcttggctcaacgggcctccgcctcccgggtttgggtggttctcctgccacagcctcccgagtggctgggattgcacgcgtgagccaccatgcccagctcattttgttttttgttcgtttgtttttgttgttggagatggggtttctccatgttcataaggctggtctcaaactccaacctcaggttatccgcccgcctcgggcgtccggaggtgctgggattgcaggcttgagccagcgcccaaggcccaatttataaatcacaaaggaatagcgtgggggatcgcttgagcctaggagttccagacaggccggggcaacatggtgaaacccggtctttttttttttttgaggcagtttcactcttgttgcccggttggagtgcagtggcgcggtctcggctcccggcggcctccgcctattgggtttgggttgttctcctgcctcagcctccggagcggctgggattacaggcgtgagccaccatgcccggctaatttttttttttttttttttggtatagacggggtttctcccttcgtcagggtagtctcaaactcctgacctcaggttacccgcctgcttcggcctcccggggtgctgggattgcaggcgtgagccaccatgcccagctttttattttttttcttttttggtagagacgggtttctccatgttggtcaggctggtctcaaactcccgacctcaggtggtccgcccgcctccgcctcccagggtgctgggattgcaggagggagccaccgcgccgggcccaatttattaatcagaaaggaacagatgggcctggcgtggtggctcacccttgtgatcccgggacttcagatggccgagcgcggcggatcgcttgagcctaggagttccaggccggctggggcaacatggtgaaacccagtccctctttttttttttttttttttgatagggagtttcgctcttgttgcccaggctagagtgcagtggcagggtctcggctccccgcagcctcggcctcccaggtttgggtggttctcctgcctcagcctcccgagtggctgggattgcaggcatgagccaccgtgccctgctaattttgtattttgtatttttttttttttttttggtagagatggggttttctccatgttggtcaggctggcctcaatctgacctcaggttatccgaccgcctcggcctccctgggtgttaggatcgcaggcgttaaccaccacgcccagcccaatttttaatcagacaggaatagatcggcctggtgtcatggctcgcgcttgtgatcccaggactttggacggctgagcgcggtgaatcgcttgagcctaggagatccagacccgcctgggcaacatggtgaaacccgtttttgtttttgttttgttttcgaggcggagtttccctcttgttgcccaggctggagtgcagtggcgtggtctcggcttcccgggcctccgcctcccgggtttgggtgattctcctgcttcagcctcctgagtggctgggattgcaggcgtgagccaccatgcccggctacttttttattatttatttattttggttgagatggggtttctccatgttggtcaggctggtctccagctcctaacctcgggtgatccgccggcctcggccttccggggtgctgcgattgcaggcctgagtcactgcgcctggcccgaaacccagtcccttaattgaaaaacaaaacaaaaaccacaaagattagcggggcctggtgggcccggcgggtagtcccagctactctgaaggctgatgtaggaggattgcttgagccggagaggggtgggggtgaggtggcagtgagccatgttggcgctgctgcagtccaaactgggcgatagagcgggactgtgtctcaggaaaacaggaaaaaaaaaaaagaagaaaaagaaagtacataaaattgctaaatcaaggaacagcttgacagtatattattgagagaaatagaggcaaaggcgagcagacaccaatgttcacttagtggaactgcagttgtccccagacaggaggctgctacttttccaaaagaaatctattattgacaaaaaaaaaaaaaaagggggtttgttacaatatacaaatagctaaactttatatagccacgaccctcttgcagcactgctctaagccttttcctgctctgaaatagctactattgttacctccattgtagagaatacagatgccagaggttgttgtggaaggaccatggaaactgactaggaaattgacttgtaagtttaggacttaaaggttcttcctgttttgctccttacattgccacattttagttaacatacctcctaaaatactggtcctttctatatttggagggactcgtcttgcagtttgaagttttttcttgcactaagcatttggtcagaagatcatgtgcgttttatgtcagtttaagtttagacattgttcagtaaggaatgtaaatatgagcaaacagttacctgattaaatagaaaacctagaagaaaaatcacctatgagaaagtcaagaaaatgtgaactctggatttgtggctattttcagaatattaatttttttggtatttaatggcattgtgaatatatttatttttaaaaattccttgtcttctgcagatacatatacggtaattaaaaaatgatatgatgtatagattttacttcaaaataattcagaggaagaaggaatgcatataaatgaagtgggaatataaatgaaacaaaactggctgtggccaggtgtggtggctcacgcctgtaatcccagcactttgggagactgaggcaggtggatcacctgaggtcaggagttcaagaccagcctggccaacgtggtgaaacatcatctctactaaaaatacaacagttagccggatgtggtgccgggtgcctgtaatcccagctacttgggaggctgaggcaggagaatcgcttgaacctgagaggcagaatttgcagtgagccaagatcatgacactgcactccagcctgggcgaccacagcaaaatcccacctttaaaaacaaacaacaaaaaaccaacaaaaacaaaaaactgtccatgccatgaatgaaaaattgttgatgatgtgtatatgtagggcagttacattatttttctcaactttttttacatctgaaactttttaatgaacacatgcacacgtcccttgataactggggctgcttccccattactctctcaatagcccttctgattttcacttcatcttcattcttagagactctggattttttattttttttggcaagttcaagtatgtcttgatctatgcaaggactagccagcatgtctacctactcagccatattatcagaaacagaaaaagtgtccagattcttgtcttttcctgttaagattttttaaattccaagaacagtcaccttctaccagacactctgatgttggaagacaaagcatatttcgtaagtggcatgatttctgtgctcaagtttagaacaaagccacagatttcaacatctcaaaaataacttactggactcaccaaatttagaaagatggagattattttaaaaaaagaaaaccttaatttactatgtgacctctaagtatctcagctgaaaattgtaaagataggtaaatcaaaagatgcagataatcatgcacttaatgaagcgctaaatcaaagtatttttggcatatgtgagtttcattttatcacattttttactggtactatagctatttgcaagtacatatagaactacagtgttacatataaactaccaaaaagcaactttttaaaaaaattttattattcttatactttaagttttagggtagatgtgcacaaagtacaggttagttccatatgtatacatgtgccatgttggtgtgctgcacccattcacttgtcatttagcattaggtatacctcctaatgctatccctccccctccccccaccccacaacagtccccggtgtgtgatgttccccttcctgtgtctatgtgttctcattcttcaattcccacctatgagtgagaacatgcggtgtttgtttttttgtccttgcgatagtttgctgagaatgatggtttccagtttcatccatgtccctacaaaggacgtgaactcatcatttttttatggctgcatagcattcgttggtgtatatatgccaccttttcttaatccagtctatcattgttagacatttgggttggttccaagtctttgctattgtgaataatgccgcaataaacatatgtgtgcatgtgtctttatagcagcatgatttatagtcctttgggtatatacccagtaatgggatggctgggtcaaatggtatttctagttctagatccctgaggatctagacacactgacttccacagtggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcatttcttcatgtgctttttggctgcataaatgtcttcttttgagaagtgtctgttcatatcctttgcccactttttgatggggttgcttgtatttttcttgtaaatttgttggagttcattgtagattctggatattagtcctttgtgagatgagtaggttgcgaaaattttctcccattttgtcaaaaaacagctttttaagaaatgagactaatctagcaactttattgagaggacgtgaagtgtttggttaggaatggtgcaattggtggtggttgtggacatgtgagatgtaagatgcctcaacttccaatgttgttcagaagcaatccagctttctgaattattcttatgaattctggatttgaaacagtaacttcccaaatggcaggggctttcagcagagaggaacctggagggaccctgtccctgacaccttctgggttgttagctccagatcaaaagaactcctgatttggaaaaagcttcttgaaaagaagaggggaggtgaccttggtgaagcctctggggacatgagctatttttagggcttttggcaggaaaagagcttttgaaaacggagataaggcatggtattaaaaaggcttacattggagaaagaaatcataaaactccatacagttagggcaatagttttgttttttactaggacagcatcagtttattggagtatttatataacataagcaaggtctcttgatattttaacaattaacaactggattttattttctactataggtgcagtttatcattctgaatccaaagccaaggaatataaacatgtatgcaaacgagcttgtcagagagtatcaacgcaatgtgtatcatctatgcttttcagttttgaacataaagcagtggctctgagcgcgactcggagggcgacgccgcggccgcagccatgggtgctgggcctgcaggggcgcgggggggagggcgacgctaggacctgcggggccgggcgggagagagggctgccgggaccggccctagacactgagccgcggtgggatccccgccggctctgcgaggccctgcgagcgccagggaggcgcctcgagggagccgggcagccgccggccacttcaggggggcccgccacttcagggcggtcgaaagagccttgggggcacatctcggggtgcggtgacccgcccggcgcatttcgggggtcggggcgcatttgccaggggacatctggagcccggccctgcttctgtcgggctccagggtacccctggatggctgcgctgtgccctcgccggcggcccgggcgccacagcggctgagttcgccgggatcgccgggccgccgccgcccttgccaccggctgcatgctcggcgcccgggtcgcggcccacctggacgcactgggccccctggtcccctacgtgccgccgccgctgctgccctctatgttctacgtgggcctgttcttcgtcaatgtgctgatcctgtactacgccttcctcatggagtacatcgtcctcaacgtgggcctcgtcttcctgttcgaggacatggaccaggcgctcgtggacctcggcgtgctctccgaccccggctcgggcctttacgatgctgactcggagctcgacgtctttgatgggtacttggagtagggtctcgactgccgttcccctcttccctccacgatccgcaacccacgccctggaccagccgcccagatcatggcgccgcagcagctggttgggggcaccatctggacggggatggttccccaggaggagaccctcccctgcctccgaggcctgcctgctaccctcaaaagcttcgtgccaacagagaggttcctgtttggacccaggagagtggaagagagattgggactgagtgctgagattgggaaggcacctgctcccacagaagggggaacgcaaggggcgtcccaagacctcatctgcctgcagcgtcacaccgatggcctggcctcggcttctcattatttgcaactgccatggatgtttacaggaacccagccagagtttgcctccctgcacttcatcccagagcgcacctgcttcctccacttcaccttcggagaggacacttcaaactgcggacacacgcaaaagcaactcccagctctgtttgatgtgagttgagccttcaggccagctgggtttagcccgaggctggtcttagatgcagcgactgtttcagggagtgactcagaataaaaagaagctgaggaagctgttggggggctgaggatgagattctcgcttcttcatttcaggttactcgttcctcagcaagttggcaaaacagatatcatgctggtgagtgccacgttactcccctggctgcaaatgcttttctgaaagtatgagtgtcgtgcctacttaattctgataaacctgtttaagcaatacttaggaggctgacttctttggattaaaaaaatgtatgcaactccaaaaaaaaaaaaaaaaaaaagaaattcaacatttaaaagtttcatttctagggcagtcttccggtttggactacaaaattattttgcttgtttttgtaggggatcgttttgtgttgttttgtgtctttctccacatgatgcttagctctttccccacgtcccagattaaagtctgtatttttgtaattgtgggcacacaatcatatctcttttaatctttgcaacgatgttgaacttctgtagacagaaggatagagaaaacagcttgaaggcagtcagtgtgtttttccatgaagggaaaaaaataaataaaaaaattaaaatgggtgcttttttaagagagattgtcctatactttttcattctgtttttcatcacgtagtttgtatcatagcaagttcattgtcattccagagttcagctttgcccttgtactcagttgtgcttttttcccattggtttttgaggttttgctaaactgttgaatatttaatgtggggacaggaatggactcagaagaaatgttttttattttgattcttactagtcttgtaggcaaaccttccattactttttatgcaaataggatctagttgaatattgtatatcgagtaaatatgcgtctctctctgctcttttcgttgatatttacataacattaaaaagattatactttatcagagattcaagctttttcttatgaatgaagccctataaataagaatattttgttacagggattttgttcttttgaaatttataacaataaagctaaaagttctctaagctgttttatattttttcttatttttcaaagtgtgaaatttttctatcatctgaaaataaattttatgtaactatagtcttagaaatttaatacatttgaattgtatatttagcctctttaatatttccaatgaatacacttcttaaaagtttaattaggaatacagttcttagtttttgagctttctctttgttgactaaattgaaatgttaataaatcatttataaatgacttttccttctctctcttttcctctcctaatttatgctcaaggccaggtgattttatagacctttattctgtgtagtttatattacaaaataatatgttacatcttgatttagaatttacattatagtatccaaaatgtttttgtcaaatgtgtgcttttatcctcagattccggcgcccctgtgactcagagtcacttctttttaggtatggagagtattaacggggaggagaaatgattcgtttgagatttagttatctatataaaatacgaattgtcaggatatttgaaccaaactgggtcatacaatttctgtggctattttgaatagccttacaatgaattaagcttactaaattccttgtacttttcatttaatagctagatgttattgttttaatttgaataatattaagtgagccatattaccaattaacctgaatataaacacttgcttgtttttaatctgagtagtttatgtcttaaagtatggaatggaactagtggtcaatttttattaatctaagtgtctcccatacttctttaagcttttggaaagtttgggaagttgtgattttgcaatgaataatctctccccttggtttcataggcaattgaaaagctgcaggcgggtgctcttgcaactgacgcagtcactgcagcactggtggaacttgaggtatttcttttctctgttttattgaaaatacttgtgagtttatctttattgttcttaaatgacatgaaactgttgagttagtcaaccataaattatatgaccagtgttgcccaccaatattagcacagttatgaagaagcctatgatattgttgttttcattggtgacttttctgagtaatatgaaagttggttaaattccttccttttcttgatttttttttttttgtgagattcatgaatacaaaagttagtgactggatactgaagtttctcattttcagtaggaaaatccttgaagttaacccccaaaaagtgatgtatgttctgttgtttaaaaataaattccaactgtctagaagtgcctaaagtagaaggggaagattcttcacgaacctaacagttagatatataccctgaaattgtgtgctgtgaagtgtgccttgtcccagtgttatggttaggtttgtccccagtttactgtggacatcgaataattgagtggggaggctctcacgtttgccataattttttatactctagagtgaggtcctctcagttctcttgatttggacccttgatgaatttgtgcaggggatattgaggtcttcagaagattgacttgctgctcgaacttggagaagatagatttgtatctatcagttgagaggattatcgtgaaaaatatttttctggttgagaatactccttagggaatcaagtaagacatgatgacgaaacaatgatgagtttgagggaggagatgatagttaaaggcgacatttccaggttgactgggttgtggcccttgtattcaggcgctcataccagggcacgcaccctttcatgcctttccttgtgaaaattgcccaggtgtttaccaaaagtcctagccgtgttttctgtatattctcatgcttaattgtggacctgagcttttgatcatgctttgtagattttaatttctcttggtaatgtcagattggtcctaatgtagtcaaggaaggtgaaagaatatggtgagcacctagttctattgaatcttacatggggatgtgtgatgccctcctaatatgactgatacatttcatgccagctctaccagtcattagccatgtgtccatgggtgtggcacagtctgtccttgactcagtttccctatttatgaggataataattcccacttcacagagttgtgaagattaactgagttcatatatgactaatacaggacagtctcttagaacagtgtgtggtacgtagtaagcacccataactgttagcaattattacagttatgaggtgctttggaagtggtatgtatgagatgaatatttatggtaactattaatgacaagttttacagcatcaaagaaagtttaattatatgttgaggatcagaggagaaaaatgacataagaaagaagatagatgtatttaccaccaaatgttacctttactcaaaacagacacacaaagagggcttcatctaacttaactaattcaattgttagttggaaattacttgcatggaatcagcataggtttgggaaagaaggttattgagtagctggagaatatactagaatggcaaccatgaatgcaaaactgaataaaattaagtttctctttttatcttagaataactttaattttcctaagtcatacttatatatcatgtttaatatttcattctattttcccctagtgttgaatctgacttttaagggatttacttatttatacttaaaaatgataagaatacattttgaaataatgagtttctcctgagtaagtggacttatagttttggataacttgtgtttttttaagagtgtggatatgaatttaaaggaaaaaaatttcttgttctattatttttgattggaataagtcataaggataatggtagcatagaattcttccccaagtgactttagagcatcccacacctcaacttttagttattttattttatatatatatatatttttgagatggattctcactctgtagcccaagctggagtgcagtggtgcgatcttggctcactgcaacctctgcctcccaggctgaagtgattcttgtgcctcagcttcccatgtagctgggactacaggcatgcaccaccacacccagctaatttttgtatttttttttttttttagtagagatggggtttcaccatgttgaccagggtggtcttgaactcctgagctcaggtgatccacctacctcggcctcccaaagtgctgcgattacaggtgagagccactgtgcctggcctcaacttttgattattaaatttgtggaagaatttcaattatctttaacaattaacttttctatggactctttgattgaaatacatgttaatagtttaaggttaagcttacactaacaggaagaattttcctaaatcttaagaattatgttggaaatcatgcttatactgccccctgcagtttctctcaccttgaataattgtgattcattaccttaaaacaggataggttttcagatggacttcagttggggaagtattgtaatagcttgggtcaatggaaagacgtaagaagattggattctaatatttttgtacttagaaaaatataagtagcagtattgagtcctttcagaatactgaaaagtgctgagaaaaattctggagagccttattaataatgcattatgtttaatttgagaataaatacttatcttagttttggtcagtctattcagttaagtcatgtctggattattgaacagatgcaaacagtcattgttctcttctctttagactttgggatatactttttgatttaaaaaatgatgttcttgccactgagcttaaggaaacaatacataaacatatttttaaaacttgcccgttatattattacttaggcagatattaaaattgatatgaattccttaaatactaattgtggattgaaatgactgaaatgttttaatggtctttattgcctagaaagagtatctggctgtatattttaaaaatgtgataatttgtattttcccaaatagtgaaaagtatactgatcttaactccatgcagtgaaggaggaagagacaaggcaaaagaaatatgtgtgtgtgtgtgtgtgtgtgtgtgtagtagtgtgttccacacacactaaagggaattatgcagacatatcattttttagcttttcttagagactgataattttgtgtcgttttatttttctttaccaccgctacagacaagtgatgtcatcttaagactgtcacttctggacaacagaatgaggtgttttcttcatttaagtaaaggaggagcaggtgcaaaagttcctatctattaaattgaccaccttctccctttagagttttgggagggaaggtggctgcttctgtatgagaggttttctgcagtgtggaaatgcaaatgatattactccaaagtatattttgtttatcttcaaaatgtagggaaggaaatggaaaggtcagtttatagatcatattttaatgatttattggtaagttgattcattcctgttgtttcgtatagcttttttgagattatcttaataactgatgagaaagtgaattctgttcactggatggtacaactctggtttcactcacagcagagaagattaatattgtgaaagaatttggtcttcatatttgggactatacatttggatgccagttgcttttttggctgcttttgaaatagttttggatcaagtagtgacagtggatttaagattccagaccataattttgcatatttcaaatggtaaaacttctaatgtgaatttcttttttgagaaaagtggatatagaactgggtgagtcatgatgctaccattttcttaggattgtttctaaaatagaaagtgtttcatggattctgatagaaaatgaactatctataaaatactgcctgaagctccttttgcacaatggtgtttttcttaaaaagtacaaagacctggtttaaaaaagtctaatgagtaataataggtgcaatatgaatgacagacttttggaaggtaatttataatcttttgtgagaaaactgatgaatttcgcagaggttttgaagatcttgttgtaacctttgagaaattttggttaattcattctgaaaactgattattttggtaggtagaataccgtgtattaagaatagtgataggggctgggcacagtggctcacgcctgtaatcccagcactttgggaggccgaagcggacgcatcacgaggtcaggagatcaagaccagcctggccaatatggtgaaaccccatctctaataaaaatacaaaaattagctgggcatggtggcgcgttcctgtaatcccagctagttgagaggctgaggcagaagaattgcttgaactgggacccaggaggcagaggttgcagtgagctgagactgcactgagactgcaccactgcactccagcttgggctacggactgagactccgtctaaaagaaaaaaaaaaaaaagaatagtgataggaatagcttttacgttttatgtagtaaaaggcaaattatacaggttcctttgttaaaaatcttttgttgaacttctgttattaaaaatggactgtgaagttttttattcacttaattcatgctttaaagctccctatggtcaggggagatgctaattcatggttaaaactcgtttcttgtccaaatgctttagcgtttatagggcagattatattgggccaagtttttagtcattctgttaaaaacagttcgtcgtctttggatctctgtgtaatacaaatattgcttgcttgtaaactctagggaagtcctttaagaataacttgttcagatgactgatattttggtatgtaagagaaagaaagtaggtattttcattatatatttatattatatataatactgttatacatttgtctgtatctttgttgttgttgagacagattcttgctctgtcgcccaggctggagtgcagtggtatgatctcggctcactgcaatctctacctcccaggttcaaacgattttcatgcctcagcctcctgagtagttgggactacaggtgtgcgccaccacacctggctaattttttttgtgtttttagtagagacggggttttgccacgttgcccaggctggcctcaagctcctggcctcaagtgatccatctgccttggcctcccaaagtgctggggtgacaggtgtgagccaccgtgcccagccaggtctgcatttctttaaggcagggatctccagaatgggaatgttggtcacacttgagtagttcattgtgagtggaccccagcgcaggcctcttgcgcagctgcaggaataggccatattctctcccctgggctttatacttccggctggaattgtctgtgtgcctcagggggatagaagaaacttctacggcctgccagtccttgaaatgcctagtggtcatggagatggtgtggcttcctgatggcatatgggcatacctaggatggaaggggacattgggaagagctgatacatttcccttttccctcaccaaacttataacaagttttcttgtgagcagatgcttaaccacaccctgctccctaccctacttcagtcatttggtttttattgcaaaaaaggaggggcatctactttaaggtcatttctgtgatttgggaagtttaaaattatttaaataaacgagcatctcatttcctgtacgtttttatttttgtagaaattatattttcataagcagagtggtcccttgctctttccccagcaccccctgccccccagtagagctgaccacactggaacgacagcttgatgcatttagctcacatttacgtaagtgctcattaactataatgtggctggtgagtctaattttagacctaccacccttgaaaatctcatttttcttttccattgataatatcttttattctctgtaaggggagtgggatgtgtttctatgtatgtgaagtagaatatttaccttttttcttttgtagtacttacaatgttttcattgcatgaaattggagttttgaccttaggtgctcttttttcctttttttttttcttaacttggtattattgatgatttcaaagatcctattttgcctgtctgtttagcagtattcccagtggtgcttcagtatttctgtgtattccagctgtttatggagtctttatgtttctctgcattttttattttttgaggtgtacacacacagttacgcttcatggagttgcatccagccaagtatccatgttcttcttgtgaagaggcagagaaaatcacctctcccaagaatttccaccttctgaacaagggaaatgtatccttaagagctgtatgcagatgggaggcaacttgtttgcttgttctgctgctagagcattggtttaattagaagacaggctgtgggtggccatgtgcagacaaagaagcaccagacagagcccgtttagcctgggtcagtaagagtaagttacactctttttaaaacacttttttgagtactgatgctgattcttgccttcagtactaaggggcaacttgtaacttactgtttgtgtttacacatagatacatctgttctttttctgagaccctagaaatgacacatgctctctagcacaaagtacctgcgcaatggaaaagcagtgatttcttccccaaccaccctttttttttttaagaataaaaagaaaatggaatcaatgattacattctagattaattttacactgtagcaaacccggtgttagcgtttgaccaagtcaaaacacttaagtatagagcttgtcatgcttttactttgtagtaatgggaacatgagaaacgattttagccttttccagccatttcttgataaggtatgtgggtctcatcagatacattcatccaggccgaacctagtagaagagagggtccaagatcagacctagcagttcctgaggagcatggaactctatatgtgtgcccttgtttttctctgggagttgttactctcaaaaatatacttcattttggaattcagttttgagctacctaaagccacatatggtagtgtggtggagttagtggaaatcctgtgtttttgactatgtgaaagcaatttagacttttggatttttgagtgtacaatgtcttctagtcctatattaatagggatattacacaaaagggatttaattagattcattggtcctaggatttatagtgttgtgatttttgaatctgtgtgtgtgtgtgtgtgtatttgtgtttgtttggatctgtatcatttgtggcatcaggtttataccttagcatctactgttttggtttgttttgctcttggtaatgaaggaagtaggctaaaaagatttttctatgtttggaaaatcacaggctggtatgatggtgtttaatttcaaagactaccttttgattttaagtttttttccatctctcaaacccacccctttattcagaatctggaaaagaatgaggaagaaacttaagttacataatttttaagattctcggcctggcacggtggctcacacctgtaatcccagcactttgggaggctgagacgggcagatcatgaggtcaggagatcgagaccatcctggctaacacggtgaaaccccgtctctactaaaaatacaaaaaattagccaggtgtggtggtgggtgcctgtagtcccagctacttgggaggctgaggcaggagaatggcatgaacccaggaagtggagcttgcagtgagccgagatcgcgccactgcattccagcctgggcgacagagcaagactccgtctcaaaacaaaacaaacaaaaaaccagattctcatcaagattctaaatcttgctcttctctctttctttctctttcatgtgttcattacctaagtgttagaataatgaaggattgtacctcactatagaaatcagcttaaagttgaatcttagacataccaattgacaaaagttctttggccattcccattgccaggcagtttttactggcagtcattctcactcagggtccagcctcctgcatggtgtacacatttcctgacagctcatgacacgcatgtactgtaacacaggacatcaacactataacacattcatagtggggaatttatttatgtttagtttttctggagtatgtgcaaatgtaagcatattttctagtgggttggaagtctttttattaaaaaaaccttagtagaggacttaaaagttactagtatccctctttcctctccagttctgaccatgtcatttgataaaaggatggtttaaattattataattccatggtctgttaggttcttcttgagtgatatttccatattattgtcaatatggttaaaaggtataattatttaggttgaagggaagtataagtagatgtatacagcagatggtagcctctagctgagatcccaaggagaatatcctgttactgggaaagggtgattatgtgtttatttagcaaacacaaagtgtttaccatgtgccaggtactctttaagcactttacaaatattggctcattagttttcacaagtgccctgagatgggtactgttgttagccctgtttgatgaggatactgatgcacagagtggttaagtaatttcctcaaggtcacatagctaggaagtgttggagccagaaatggaatcctgctgccgtgacccactcagtcaattttttttttttttttgagaccgagtcttgctctattgcccaggctgcagtgcagtggtgcaatctcggctcactgcaacctccgcctcctgggttcagacgattcttctgtctcagcctccccagtagctgggactacaggctcctaccattacactggctaatttttgtatttttagtagagatggggtttctccaagttggccagactggtcttgaactcatgacctcaggtgaggcacctgcctcagcctcccaaagtgctgggattacaggccttagccactgctcccggcccctcattcagtttaatcaacaaatgaacagcgtcactaaagatccctcaaactcagtgatgaacacatctgaaaaagttaaagaaaattaagttcaaagaagaaacttttcattgtcaccattgtcggtgaatgtagtgatctaaaaattctctttatcattgtgctttaaatagtgatttagttttgatctttaaatgtcaatagactattgatattttgatctttaaatatcaaatatgtatggactatgtgaatattgaaaagaaaatatgaacagtcacttttacagttcgggtttttgtcttaaaattttgttgtaatttctcttcctaatcttagatctgtttgaggagatggtgcctgtgtcagtgtggcagtctttggctgcctgtgatcagaggaaagccgatttgttaacagatcaattgctcagatgagagaagccaccactttggcaaatgggtaggtagagcttaattttagagcctaaagttttccgtttggttgttctttagtttgtgaacattttagtttctgagcttagagctaaatgtcaagagtatataaaatagaaaatgtagacacacacaactatttttggtggacactgtatttgtgaagctctagcaaatatagttggaagaaattatagaaacaaggtgaggatgtttgactaaaaatttgtattttaagagatatttatttgggggaaatgagaagtagaaatgaactcagatacatggtacgtttagtgttctgaaccaatttttgtttctgatggattggatactaagaaaataattcattggtttaaaaaatttttaggtatattttgcacacacaaaatacacctattctaagtacacagttcaattattattatatgtatatatatgtttatgtgtgtgtatatatatatttttttgtttgttttgttttgttttttgggacagggtcttattgtcaccaggctggagtgcagtggtgtaaacattaaacatggctcactgcaatctcaaccttctgggctcaggtgatcctcctgcctcagcctcctgtgtagctgaggccacaggtgcaagccaccgcacctggctaattttttcatttttttatagagacgagatctcgctttgttgcccaggctggtcttgaactcctgggctcctggtcttgaactcctgggctcaagtgatcctcttgccttgacctcccaaagtgctgggattacaggcatgagccaccatgcctggctatttagttagttttgataaatgtatgtacccatgtaaccggcactatgattaagatagagaacattactgttaccctaaaaaaattctctcatgcccctttcccagtccttcttctcctggcccctggccactattgatctgctccctgtcttaagtttagttttactttttatacaatttaaaatacatgtaatcattctagcatatacatatacagtacttacagtatgtacagtatatacttagaatgtgttttgctttttttcacttagttactgtttttgagattcatctatattatgtgtatcagtttgagtcttttctgtggctgagcagtattccattttatggttatggagtagtattccattttatggttatagagcagtttgttaactctttcacctgttaatggacatttcagtttctatgaacattcgtgtataaagcttcatgtggacatattttagttctcttgggtaaatacttaggagtggaattgttaggttgtgtggttagcatatttaattttacatgaaattgccaggttgttttccaaagtggttgttccattttatatcctatctgcactgtttgagaaatacagttgttctgcatcctcaccaatacttggtaccgtcagtctttttagttttagctgctttcgtgtgtgtgtagcagaatctcactgtgatttaatttgcattctcctaattactaatgatactgaacagcttttcatgtgcttactagccattcatatcttttctgtaaagtgtctattgaaatctttttctcagtttttaaaactgagttttcttaatatttaaagagttctttacctattttggaggcaagtcctttgtcagatacatacgattgagaatatagttgaccctgaacaacataggggttatgggtgctgacccccctgcacagccaaatctgcatataacttctgagtccccaaaacttaactactaatagcctgctgttgaccagaagccttactgataacataaacagtcaattaacacatattttgtatatgtattgtatagtatattcttataataaataagctagagaaaaaatgctattaagaaaatcataaggaagagaaaatatatttactatgattaaatggaagtggatcatcataaaggtcttcgtccttgtctatttcatgtttgagtaggctgaagaagaggaggaaggagggttggtcttgctgtcttagaggtggcaaaggtgaaagaggtgaaagtccacatatacatggactcacgtagttcaaatctgtgttgttcaggggccagctgtatttctctcgtggttggcttgccttttcatgtttttagttttgattaatgcatggattttaccatcatttttcttgaacaagaaaggaatgtaagtttactctagcatatgataaacaggcagtctgagattttacagagcttcttttctgaggagttcattgtattccatcatttcatttgccttttttctttacatagtaggtagggatatgtacctcccttccccatcatgtaaatgaaataactgaggaatcgttagtgtgctacaaaaccgagagcagatgaagattctgtaatgaagacttagatcatctatcttctgttgacattttgcctagatgatgtgaaattataattattgattctgttgaaagagagcaaaaaagaaaaaaatacctattttgtgtattgtttctgactcgttagagatgctgtaacaatcaaaagtataaaagactgcttttttaggatagaatttttgacttttaattacttagactgaaacaagtttgaactgtaagccaacgatacctaatatattttaatgcggtcataatttttcggcttttttttttttgtttttccagactgagtcttactctgtcgcccaggctggagtgcagtggtgagatctcagctcactgcaaccttcgtctcctggcttcaggtgattcttgtgcctcagcctcccaagtagctgggattataggtgctcaccactacgcctgactaatttttgtatttttagtagagatggggtttcaccgtgttggccaggctggccttgaattcctgacctcaggtgatccgcctgccttggcctcccaagtgctgggattacaggtgtgagccactgcaccagcctattttttggcttttaattctgaattgtgaacttaattttttaatgattttggtttaattgtatcaatcactgatttttttgtttttctgttaatctttgctttgtttttcattgatagggcttatccagtttttctgggtgctaactccattgctgttgatttggttatagaagattaaattaaataaagtaaatattgatgagttaaattgttttagacttcaatataacatagtatctcattttttcagagtgctagcttcccttaatcttccagcagcaattgaagatgtgtctggagacactgtacctcagtctatattgactaaatcaagatctgtgattgaacagggaggcatccagactgttgatcagttgactaaagaactgcctgaattactgcaatgaaatagagaaatcctagatgaggtatgttttataagatttgcttttcaagtataaacactgtgatcccttgatgtccagcagggattgggactggagacttcctcatgctagtgctcacagtgtagttagtattcatcactttggtgaatttactgtggcccagagccgcctctttagcataagagtaattctggttgagtgagaatgggtttcattcttatcttaagggtaagtaagtacacattaatgaaactcaaatgaccactgtgtaaaactagtatactatgagaaatcaactatcatatgaaccgttcagtctttgtaattattgatttattttatacatagcgtgtagcaagatttttctttttaatttaatttgtcttaacctggaaggttaaaccctttaatttatccctaatttcttgaaatatattaagtatatttattttatattatttatcttataattccaatgtctgtggtttctgtgggtttgattctatgatttgtaatttttgctgattcttgcttatggtggcttgttttctcttgtgttcagtttttttgttactgttttttaaaactttaaaaaatagtttcagatttacagagactttgcaaatttagtgtggaaagttcctgtatatttttcacctagcttccctgaaagttaaaatcttacgcggtcgtggcacattgttaaaactaggaaattgacattggtacagtattattactcagattttaccagttattccaccaacgttcctccttctgttccaagatccagtacagaatactgaattgcatttagtgttcagtgagttttgattgtgcattcatatttcctgtaatttatttgtgggaattcattgagatctgggtttaaggtgaattctagaaagaatttgtgtttgcttctgccataaaaaggcattatatacctggcacctcctcaaacttaagaggctttttcctttcttttataatcttttaattatagtagtaatttatcttaggactttgtgtcacacaaatagtgtggtttctagtcccaaattcaggcttttgatcaggaatctcagataatacttctttttttttttcttttttctttagagccaaggtccagacaggcatgttttcttctgtagggccgttttctgttttaaaaattcatccactgagaatcatctatttggaagtataccagtttgagtgtggagagtgcttttgatctgacctctcaccttttattgtccctacctatgtttcttgttgacttttcatgttctaaattcacaatgcaagtcaatggtgaactacacagctggtgaactatggatggtgggctagtgctggcttgtggcctacttttgtgtggttcactagttaaggataatttttatcttttttagagcattgtcaaaaaagaagaattctatgtgccatagactgtggcccacaaagcctaaaatatttactctgtggtgtttgacagaagtttgctattctttgtcctaagctatcagggattgtcatgtattgttggtgctagcactgtgtctactggtagattagtattttcttgtgtttctggccccctactatcctgtcatcttatctacacattaaaaggcatttaaaaatatattaaacataattttctgttcgttgtattggaatgaaattctaaatcttttattttttaatgtaattgatcagtttttcccctttgtttatggcttctatttatctattttaatcttaaaactttctttaaattgatacatggatgtaaatagtctcatgtattcttcctttttttttttactgagaaaggtgatagctaattcagccttaaatttataagactttttgttaaatgcattataacttagatgtctgcaagaaaaaagtcgatttatattctaacctagtattcccatctcaccaaattctcccttatattgtgtatgaacatttaataattgcattaaattttttaatccagaaatgacatttcagggttctttttgcttccttttaaagtcattaaggtttttggatgaagaagaagcaaccgataatgatttatgagcaaaatttaaggaacgctggcaaaggacatcatccaatgaactgtataagcctttaaaagcaggtaaaaatgtgtataaatgaccttcatttgaataaattcccaatttggacccacatttttacttgattaaattaggctcagttgtaaattcgtttttaccgaaattgtttttcctcagttttagtataaagattaaaaaagttcacaaaagtaatctgccaattgtcagaagtacagattcttaagaacagtataaagggaaaagttaaaatggtcctccaactttcattttctgttccaagctctgtgcatattttattttatttattttttttttgagacaaggtctcgctctgtcacttaggctggagtgcagtggcaggatcacagctcgctgcagccccaacctccagggctcagtcaatgcttctacctcagcctcctgagtagctgacaccgtagacatgtgctaccacgcctggctaatttttgtattttttgcagagacgaggttttaccgtgttgccctggctcgtcttgaactcctgggctcaagtgatccacctgcctccacttcccaaagtgatgagattacaggcttgaatcaccatgcctggcccctgcgcatattttaaaaacataaatgagagcatattatatttatggctttgtaatttttttttcatttagtagtgaatcctgggtggtaaaacgaaaatgagctttaagttattttgaggccaaatttatgcttcttaagactttgattatgaagattttgtgcttgctgagataaatgctgtcttcatggtggctggagattagttttatttatctttgtaaaaagtttgtatattattgagatttttctaaaaatctttttttttttaagtcacattgctcttttgagagaggaatacttttaaaataaatggaccaatttttggagagaatgatttcttcctacattcatgagttgtaggaaaagattaatattaattagcttttatttggcagatagtaaccaccaaatgtattttaaggtatagctatgcttttgattttataagtgattttgtcatctttccaaaaacgagaacgcaaagactgttaggagctgtttttatgattaagtgaattggggtctagagaaggggaagataagtaaagttggagactagaactcaacatataaccaggccatacacgttgctgttagaatcacttctgtgctctgcaaacctattttctcccagagggaaccagcttcagaacagttttagataaagctgtgcaagcagatggacacgtgaaagaatgttacccgtctcatcgtgaccccatcgtgcttttgtgtaagccagagcctgagctgaatgctgccatcccttctgctaatccagcaaagaccatgcagggcagtgaggtgagaagggcactttgatgtgggttgtcatctgcttaagaaaaccacattcaagccattttatataatgcactgccaattccttattgtcatctttaaaaaaatgcagaaataaattggggttgttatatttaaagtagtatatagactgtgtaataggaaattatactaatattaactatcctgtaatagtcacttccatttattgaatgcccttttttgaactaaattttagatacttcataggtcaacagtatttaatttgggttttataaaagagagaagcttggaagtatagaaatttcctgaaatgaaaggactgggtatggccagatacacaaattctttatttcttccattgttctctactcccttccaccttgtttccccgggactacctttgaaaggaagattggcaaggtgtgcgtgttaataaatggatagctccgtcatggtgtttctactgatgacaggaaagagaaaattgaatagtagggcatctgatttggaaagtcctaagagaaagtgcaactataatttaatggcctatcatggggaggtagggtaagttagtaggaaaagatagaggtcccaaatctctgcacaggaaaacaagccaaagggcaagaaatactgctgaaaacttcttgaaaaaagtgaatttcctgggatagtaagttctgaaaagtatgagttttgtttcttatttgtctttccacagatgcattttatatgtttcatatatgtattccaagacctactggatatctgctctgtgtaaggcactatggtaggtacattggaaaattaacatacaaattatacacaggctttaccctcaatttatgatccattgtggaatattagtcatgtacaaggatgactgtaatatagggaagaagtttaaaaatgtcacagggaaagtatagaagtatgttatgaggatttagatgaagtacttaaatttcagtaatttggagtagttctcttcagaggcttcttaagagattggcacattatgaggacagagtggataggcagaaaaagtaaacgtgtaggatcggagaagggctgagtagtggctgtgtctagagagttatccgaggcacagaggatctgcaaacacagcttttactcctgatttctcatgacagaaggtttacagacatgttgagaatggctggaatctgcttgtttatttatttattcaccaagtgtttgaaggcctgctattccagagcagtgctgagcaccttggtccctaacataaagagacaaaaaactgctctgggttacctttagtgtagggtaaatgcacaggtaccgggcacctctcaaagggaagagaaggctacgtagttgaatgtgcattgaacctgaatctaacgggggaacccagtggaacagggaatgtgagttgttgctttgaggacatagcggagaaaagggaggtggtcagaagattaacttgtgagcaacaaagaacccgaagaagaaactgtagacccttggaagagcaatacattctggtaccttttttattttagaaaaagatctctgtttagtactctctttgtattctttttggtgtcttgtacgtgactcagaattatgtggcttttgccctttgattcttctgctttcagtagaaaagtaaaaatggtttgtgctaagcaaaatctgcattagtatgcactgatttgttgatattttattcagttgtatcagttttattaatccttacttgtgttacacaggagaaaggaacttttatagtcaatatgaagtaattttttggaagctagagttcttgatggggtaaccacaaaatttcagtactctctatatattcgtttgtcgtgtgccttaatcaaataaggcaagcatcaggtttatcagagctatttcagatggttgtcataatagttgatgacgcattttagccagaatttttatgataaaaactcagttttttgattgctgattagagtgatgcaatgtatatgttttattaaaaagtccaagtttgatggtagggctgttttttcttttattgtgaagtagcctactttctagttacttattttcagtctctttgggcatctggttttagatattgagatactctgaaaaattttgcagactagtggtcatttgtatttcaagatttttgtattaaatacctaggatcactgcttgtgattggttgcctatgatctactgtggcctgaagtctggtctgtggttggctggccaagccttggccctaatgtatatggggctgagtctagccaggggaaggaacatctatttttttgcacaaggatgatgttcaattttactcaaagtgttacatctgctggaagtaacggagggggtacctttaaaaaaaaaaaaaaaccctttatctccttagaggtagagcataaagagaactgtttaaaactgtgtgccctcccagaggagtgccttttttggattcacagactagtggaggatctgcaaacacagcttttactcctgatttctcatgacagaaagtttatagacatgttgagaatggctggaatctgtttatttatttactcaccaagtgttttttgaaggcctgctattccagaactgtgctgagtaccttggtccctaacatagagagacaaaaaactcctctaggttacctttagtgtagggtaaatgtatcaagtttctgctttcgttggtgtagacatagttgcttatttgccttttctgaaaataaaatgacaaggttataaaagtaaaatagaagatttcattgagggcatttctttctttctttttttttttggccgtggggggacggagtcttgctctgtcacccaggctggagtgcagtggtgcaatcttggctcactgcaacctctgcctcctgggttcaagcaattctcctgcctcagcctcccgagtagctgggactgtaggcatgcgctactatgcccagctaattttcgtatatttagtagagacagggtttcaccatgttggccagggtggtctcgatctcttgacctcgtgatccacttgccttggcctcccaaagtgctgggattacaggcatgagccaccgcgcccggcccattgagggcatttcttacggcttatattgtacttggtgctgttaaatgccacagagggttttaaatctaaaactcgggtcaggaacctgtggcttgtgggccgaatcctctgcctcttctctttgtatggcctgggagctaaaaatgagttttacattttttaaatataaaactctactttctacttcattttttaaatggctaaaaaaaagtcaaacgaatgttttaatatgtgggcattatataaaattcagatttcagtgttaatacatttttgttgaaacatagctgcgctcattcatttacacattgtctttcatactacaaagcagagttaaagagttggaacagagactgtggcctactgaggcaaaaatattttctgtttggtcctttaccaaaaaagtttgtaagttcctgatctgaaagacaaagtattgacagcctaggtgatgccgttcctgccattctgtttgacctcatctcctgttctgccttttgtttactatgcttcagccagagtggcctttttttctttcctttgatcctgccaagcttgtgcctgccacaggactgttatatttgcgtttccttctgtgcagggctttcttcccatttccatggctattacctctttttcattagtctcagatgtcacctcttctccatctttgtcattgtctacccacattattctatttttgtgtatttgtttaatcctcccctttccatatttatttaatcctctctggtccccaaatgaaggaaaagactgtttttgttagtagtcgtgtccatggcatctagaatggtcccaaaacaaaaagcatttgtttgaatggtcatcgctggcagccttaacttaataaagggatacatttaattgcagttgaaaggtagctggagctgtgtataagaaataaatatgctaggattctaattatttatatactttgataacatgttaaacctcaaatttgaatttagaagaaaatttaggcagtggttttcttattatcgtggtcattcatttgtggaagcagtttaattcattttctacttcatttactctgttaaaatgaggcgagtgtcatataatctgaaatatgttaaactagtgcactgcatatgaatttttttaaaagatgttcgtaatataagggatctctatctttgtgtggtagtccacaagtttgttcataaattcgttgtttgaaatggcatttttttccccagaaagttagaattattgcatttttgaatatcacaggatttgttaactatttggccctctgtatcagtctggttagaaagcttctgtatcagtctggttggataccatggaagttgcggtaagcttttcttcctaatctaggtaatatgactgaatacttaccctttgttagaagttatgttgagcactttatatagattatctcagtcttcacaacagtcctgaaataggtactattatgcccattttgcagctgcgaaaattgagttttctaagtagtaacctgtccttgattgcacagtcactaagcccattatggtctctaagggagtatagtcagagttgaagtgtttttaattttctatgtaattacgttttttttgtgtaattacgtttcactttgatagaccattagttcatttgtttccatattcaagttttgacttaatcttgttttctgagtgtgtaaaaaatgttcatgattcaaaaggtacatgcagagtaagcctcattccttttccttctacttctttcctgtatacttcctgtaagtaatcatatccgttagtttctggtttgtccttactgattttctttttggaagaacaacaacaaacaaaaaacccaacctcccccaaaattatgcatacatatgtatacatatgtacatattatgtatgtgtatatttattttctgattttccttctgtcttactcaaaatgcagcacactatatatgcttttgtaccctttttttctcatttaataatatgtcctggaagtcacttggaaggaaacttttattcacatcgtctgatatcaagttctactaggtctttaaacagactttgtcatatccacccacgtatgattctttctcctcctccttccttttagagtttctgtggtttgatgctttctagactctaggaatcatatttctttccctttccacagccttctcccctgtaccctcttctttctctccctccctctctccttcccttcccccttccttcctctcttgtccccctcccccttctcttcctttcctttccttccattttaaaattaggatgtttagaagatatagatgtaaatgaggccaaaaaggaaattcgcctacatttagcagaaacctcgagtctctggtcttcacaaagggatgttactttggacgttcctatcaaggagttaactaagactgtggaagaaagagtagggtaggaatttttagaaacaggcagttggtagggggatcatgggaactggacttgctgctggtaatgagaaagacaggggtggagacagggctcatgatgtcctcttcttccctttgtctttccccctgttttctttctatgagcatcattggggcaagcagaatagggagattgggttgatgttcttggtggtcctagcaaagtatgaagagatgagtgaaaggggcagcttgaaagtgctcattagaaggcacttgaacactatgaatataaaggggtatttatgaatcaggtgggtataagtcagagagtgtcttgactgaatacaagagataaatctctgttttgtttttgtattttgttttgagacagggtttctctctgtcacccaggctggagtgcagtggcatgatcatggctcactgcagccttgaccccctgggctgaagcaatcctcctgcctcagcctctggagtagctgtgactgcaggtacacaccattgcacccaactaatttttttttaatgtagaaatgggggtctcactttgttgcctaggctggtctcgaactcctaggctcaggtgatcctcctaaagtgctgggattgcaggtatgaacctctacatctggcctaaaactcttaatgctatgaagagaggcacaagaaccctctttccttttcctctcccggtgtataaaataaatgtggtatatacctttatatctgtgtctttctctatttctttctccatctaccatgcttgcttcataactatctctatttctatcttcacctctatttctctatatctctgtctgtcagtctctctaggcaaaataggatatctacttacgtagcaaaatcataccttcccctgcttcacagccatgattgggagggagtagagtgtagagtggctaagagattggttttggaactagtcagacttaggtctcaaatttcacctctgccccttagtaactgtataaccatgtcacttaatttttttgagactcgttatccctatctttggaagagaggtcataaatatatataccccatggggtattgtaaggaatacataaaattatatttctgaagtgtttagcatggtgcctaacacataggagttcagtaaattgtagctgttggctactgttattaatgctgcttttgttttaatatgagtcaactgaaggtacagtgtctatctacataaacctgatgttcaatttatatttggctctctgagaactcatctctctctcagcccaaatgaacctttatatattatttccttcttgaaattggctttttttttcagttaaactaaagtgtcttttttattgtttaggttgtaaatgtcttaaaatccttattgtcaaatcttgatgaagtaaagaaggaaagagagggtctggagaatgacttgaaatctgtgaattttgacatgacaagcaagtttttgacagccctggctcaagatggcatgataaatgaagaagctctttctgttactgaactagatcgagtctatggaggtcttacaactaaagtccaagaatctctaaagaaacaggagggacttcttaaaaatattcaggtgaaatttatgtatttaataacatctatgttttaaaaattacagaaaagatatgtctggactaaacctatattcaattagaaaaatgacattggagaatatctgtagttgagagtagaacttaatacatatatattttgtaaaattaaacttggcatatcagttttatttgtgtctatgaaaccaagtcactccttgtttttttttttttttttttttttttgagatggagtctcgttctgtcgcccaggctggagtgcagtggtgcgatcttggctcactgcaagctccgcctcccgggttcacaccattctcccgcctcagccgcccgagtagctgggactacaggcgcccgccaccacgccctgctaattttttgtatttttagtagagacgggatttcaccgtgttagccaggatggtctccatctcctgacctcctgatcctccctccttggcctcccaaagtgctgggattacagacgtgagccaccacgcccggcagaaacaaagtcatttctatggctaaaatgttgcatattacttaggagtgcttgatacttctgatatttttcatggtttcaagtttttaatagctttgttttttttttccatacgggaggaaaatcgaaattagttggaattactgatacctttaattatacggctaacatacatacagacttcagtcattttttaaaaaaataatgcaaactaaatatgttgagaagtttgaagttagttttcgtgtttacagataggtagtttggactaacaaagacttgaaagtttgcccttttcatagttaatgtgcaaaattaaacatatatttctactcctaaacattgtatctatatatgatataaaatattccaaaaggtaaaataattttcatgttatattttttgcaagtgttatatactaatagaaatctgtgatcattattggttgttttgacttctattggatttttgaaatttttacttaagaaagatttaaagcataatgaggcttcaaaagagtatactaggtatttctagtaattttgcatatgtatttaattacatatgattttcataattggaaaagatcaataaaaatgttatgagccatattttataagtaaatgtaaatacataaatctttcttttaacaaggtctcacatcaggaattttcgaaaatgaagcaatctaataatgaagctaacttaagagaagaagttttgaagaatttagctactgcatgtgacaactttgttgaacttgtagctaattcgaaggaaggcacaaaggtatgaagtacatgcaaaaggaaccatagctagcaagtacagatgtgaacgtataggttggaagttaaatggtatttccagttgaaccaaattactctttgcctggaatgttagctttaatgccattgcctctgcgaagtttgttacaggagggagaaagcttaatgaaggtggcaacatttcatgggaaccttgaagaatgaattgcatatttcaactggcagaaaaggggtacaaatattccaggtagcaggaattagcagagatgtcaatgacacctttttaagggataggaagttgattaatttgatgaattttgaggggacaggagtagtcaaagctgatttgtgatggaaaagctgggcgggcatgacttttatattctgtgtggtggtttgctgaggacagacttgtggcctgcccaagtgtcagaaggcttgctgaatatgtaagtactttcttgccttgtcctttaaaaagtttagggaattcacttatatttgtttttaccaatttgtttttgagggaacagtgatttttaagttttctcagatgcataattccttttggtacttaacttcataataatcactgaataaagttaccttgatataaatacagtagctaaaatgtaaaaccctctgaagagagggtgaaaatactgcaaagccttccaaatagagaggatggtaaaatgccattttaacttggtttaaaatgctttgtttaaataggtaagctgagaaaaccctccagagagcctttagaaattcttttaagggtttctgaagtatgcttgcatttctttttttttttttttttatactttaagttttagggtacatgtgcacaacgtgcaggtttgttacatatgtatacatgtgccatgttggtgtgctgcacccattaactcgtcatttagcattaggtatatctcctaatgctatccctcccccctccccccatcccacaacagtccccggtgtgtgatgttccctttcctgtgtccatgtattctcattgttcaattcccacctatgagtgagaacgtgcagtgtttggttttttgtccttgcaatagtttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcagtaaacatatgagtgcatgtgtctttatagcagcatgatttataatcctttgggtatatacccagtaatgggatggctgggtcaaatggtatttctagttctagatccctgaggaatcaccacaccgacttccacaatggttgaactagtttacagtcccaccaacagtgtaaaagtgttcctatttctccacatcctctccagcacttgttgtttcctgactttttaatgatcgccgttctaactggtgtgagatggtatctcactgtggttttgatttgcatttctttgatggccagtgatgatgagcattttttcatgtgtttttggctgcataaatgtcttcttttgagaagtgtctgttcatatcctttgcccactttttgatggggagtatgcttgcatttctgtagtgaatttgaaaacctaatccttccacttaaataggtttcatgttattaaacaattgacttttctctaggaattaggaagattttcatgatcatgaaacttttaacttgttacatttttgatgataatgttctataaaaatgattttattatttttattttctttaggagtcttagatcatatttaatattaagttgttgggcctagtaaattgtatggatgtatctcatgcagatctcagttcttcggctttaactgtcattgacaaattagctttagatcacattactctctggattaaaaaattgttcttgttcattacttgtatttgttctttgcttatagttttacaatgagttgactgaaatcctggtcaggttccagaacaaatgcagcgatatagttttggcatggaagacagaaagagatgaactcttaaagtaagtctgttttgtgtatcaaattgtacttaagaattttcttttaaaaaatcatgtggagacttttggtgtgaacttggtagtatgagagcagtttccctccttttctcatggaagaaggaactagatagagtattttacaaagcaacaagtaaacagctgcacagtctgggaatgaaaggatgaaaagaagcagaaactctagatgcaggaagtacagtgaggtcacagaaatgataaaacagttcaggtggcagatctcaggaagtgccagtaaatacaagcaatttattttgaagtggcaaataggttccttacataaaactagagctatagaacatggaggagacgccgtgaatagctcagagaataccagcaaaatcactttcagaggaggctgctgagaaagcagggccagttaacatacgactcatttcctgctgagtaatcaacacggagtagcacagcgctgataaaaggtgaaaaacattaacaaaatttaataaaacttcatagatgaagaatatttaccaaaataatattgtcacagaataggtgaaaattatgagcaaacgtctgaccatgaactaaacaaaaagaacaacaacaacaaatgtaagaaggcagtcattctaaggccggggtccccagtcctggggccatggactggtactggttcgtggcctgttaggaactgggctgcacagcaggaggtgggtggcagacaggccggcggctgggcgagtattactgcctgagccccacctcctgtcaggtcagcctcagcattagattctcataggagcgcaaaccctattgtgaactgcccgtgtaagggatctaggttgtgcgttgcttaggagactctgactaatgcctgatgatctgaggtggaacagtttcatcctgaaatcatcttccgctcccctgtggaaaaattgtcttgcatgagaccggtccctgatgccataaaggtttggggactgctcctctaaggaacacttggagcagaaattccagaactgcaggaatatggtaagaaaacaggaagtggtaagatgtgaggtgtcagaattcaggaaagaagtagaagggaagaatcaaaccacgacatgggaaagagcacaaagggcgagtaaacactgaagaacacacaggaacacagagtagaaatgaggaaattaaaatgaaaccaaagtcaagaaagaatgagaaaggattagagagaagatgggcacagaagatctaatatgggcaaaactgaatttctctcaaagaagaaaaaccagacagaacagttatttaactttctgtaaacagagcacttatttcatgatactcaagaacattttcttaaaacaagtgaaggttgttgaaagaggatatcacatggtaggggaaattgatcaagaactgtcagcatcaaggcatataaattattggccttaaaaggtaatggcagaatcctttaggcagtcaggcaaaacaatcaaaccagtatataaaaaggtgaaaaaaattaggctggcagctctgtatgccagaagagagtggagtgattgctgtaatctcaaggatagtaaatatgagctaaagattttatatcatatagtaaatacatgctaaagattttatatccaaactgtccttcgggtgcataaaaagccatatattcattagtaataaatataaagagctgaaagagtcttataccgatgaccctttcagccaactagatctttattcatctctctgttcatgttcatgttcattcacctctctgctcatgttcatgagagaagttattttcttctacctctaagaaagagcaggtgagttgtttttagaatatttctactaaacctataaaaagcaaataattagaatgttttaaaaatggttctaaatgttttaaaaaaggtgacttttttttagatagagttttgctctgtcgcccaggctggagtgcaatgatgcaatcttcgctcactgcaacctccgcctcccgggttcaagcaattcttctgcctcagcttcccaagtagctggcattacaggtgtgcaccaccacgcctggctaatttttgtatttttagtagagacagggttttgccatgttggccaggctggtctcgaactcctgacctcaggtgattggaattacaggtgtgagccacccccccagcctaaaaaaagatgagtattctccatattagtcttaaagataaaaaaaacctaacaaagattaatacaaaacagtctacagaccagtttcagttatgaatatggatgcaaaagtcctaaataaagtatttgccagtaatagtcaccaggacgttaaaaaataattattgaccaaggggaggggggcatttattccagtattcagtattcagtgttttcatgtcaaaggaaagattacaggcttgtcttaatagatgaggcagaagcatttaagaaaatgagtgttctgatactcagtaaaataagaatagatagaagatagatgcttccgtaacatgaaaaaatatatatgtatgtgtgtgtatatatttctgcccaaaactcagtacagtgattaatggagaagcactataaacagttccctctgaagtcaagaacagacaacaaatgtcactgtcagcactatttttaaatactatactgcagtaccagccaagacaatcacgtgagagagaaatttaaaaattggaaaggaagaagtaaaactagcactatttacagacattatgattgtacaactacttgaaaacccaagagaaccccaaaactctgcaaataataaaataattattactgaagttgttgatcataaaaataatttgtagaaatcagtggctttcatgtaaataaacctatagaggataagatgaagagacccacttacggtagcaacaaaaaggataaaatataaaatataagtttgtcatatatgagacctgtgtgaagaaaaaactatttcaaggacacaaaagaaggcttgagcaagttaaaaagcatgttcttggataggatgactcaacttcatcaagatgtcaactctcagttaacttatgtatcaactgggcgtgatggcatgcacttctagtcccatctacttgggagattgaagtgggaggatggtttgagccctggaattctaggttgtagtgcgctatgattgtacctataaatagccacggtactccagtctgggcagcagtgagaccctatctctaataacaaacataaataaagaaataaacatatacggccgggcgcagtggctcacgcctgtaatcccagcactttgggaggccgaggcaggcggatcacgaggtcaggagatcgagaccatcctggctaacacggtgaaaccccgtctctactaaaaataaaaaaaattagccgggcgtggtggtgggcgcctgtagttccagctactcgggaggctgagacaggagaatggtgtgaacccgggaggcagagcttgcagtgagccgagatcgtgccactgtactccggcctgggcgacacagtgagactccgtctcaaaaaaaataaataaataaaaagaaataaacatatgcattcaacatgcttttgattaaaaaaaaatcagcttttcatttggaattagacaagttgatcctaaagttcaagtagaaaaagaaacaaggtcagccaggaaaacaataaaaagagtagtgaagggatactagttctaccagataataaggtatataataccatctttaattaaaacacagtggtactggtacatgattagacaaagacagaatagaaaatagaaatagattcaaatacatgtgtgaatttagtgtaaaagatcttcaaccaaccagaagaggttgtagtcaactgcccagccatttagaaaataaaagttatctttataccagagtaagttctgagtggaccaaacttgaaatttgtaaatgaaatataaagtataaaatagaatggaggagaattccttaataaagctgggatgggcaggatctaataactcctacttaaaatccagaagccattaaaaaaaagaaaagaataagtttctcatagaaatatgataaacagagtcaggatatgacaaattggggatccaatatttgaaacttattcacaggcaaaaggctaatttactttatttagaaaagaactcctagaaatgaacaagaagaaaacccaatagacaactgaggaaaagacgcaaatagaattttgcagacaaggaaatacaaatagctcttaaataaatgaaaaaaaatgaataccctcattcattataaaatacaaatcaaaattagtctgaagtaatatttttcagattggcaagaatctgaaagtttgtttaaagcctgttctgggtcttccacattcattattctctacggtcaatcacattccaaggattgttgcctccaatgcatgcctttttctcaattttattttctcccatcagagtcatgcacagattagctcccaagtgagctattataatggcctcctagcatctaaactctccttttttccaattgatagttctgccagagttgtcttcttaaagcagaggttagaccgcatttctcttaagtaaattccaatgacaccaaaacagtgattcttaataagaattacaagtagggaaatacagatgggagagtttgcttagtaaataagttcataaaatctaggttaaacaaagttaaatggggtttgctttttgctgttgctttgttaatgtgcatttgaaatttctaaagtggcattacatatccataatttcccttatctatttgacaaaggaatctggtttgtttagaagcattttttcagaactgtgataggtcaacctttcagaaattcctcattatcaacagtcaaatccagatgtattttctttggctctcacaacaggcttagaggaatttctagtctgttctcctgatgtttcattatgtgcatcttttgcttaggcctgttaaacctactcaatgtgtgtatcttctactccatgtctttattcctactgttgtcttaacaggaaatccttgcaacccaattcatagtttttgttctttggaaaaatccaaatcatgtatcatgaatacatattttttctctattgggatttgcctgtttttatgtatcacagccagaagtaatcactgcatagtgtatttctgtagaaagatagaagagttctattttaacacaatatttcctatatacccagcaaaggtctaggtatttatacatactattgtatttattcatctcatcaatgcaatgaagaaatattaataaatccattatatatgctaaaaggtagcgacacatatatgctacatgtgcaggttttctcaggtattattagctagggaagctgtgttgtaacaatcttcaaaaacttctttctattgtttacatgctattccacatcattttgttttcatttcttttgtagtatctaatgtattctactaaaaaaaaaagtagagtagttggaaaacttgtgaaaaaaacatatgtattacatatataccattcttcatgattctcaaaattttcatcattattaatgttttgtgtatatatatatatatattgtgtgtgtatgtatgcatgttagatatataatttaaaagaaaacaataagttggtggcttatggcaaattgttccttaagtcctgcatttgaaacatagacactgagtgaatcagcacatttgatcatcttttaactacaatagatgattatacattaaaaatacattaaccatccaaatacatcttttttcttatttatgtatgtatgtatgtatgtatgtatgtatgtatttttatttttttgagatggagtctctttctgtcgcccaggctgaagtgcagtggcgcaatctcagctcactgcaagctccacctcccaggttcccgccattctcctgcctcagcctcccgaatagctgggactacaagcgcccgccaccacgcctagctaatttttttgtacttttagtagagatgggttttcaccacgttagccaggatggtctcgatctcctgacctcgtgatccgcctgccttggccttccaaagtgctgggattacaggcctgagcctcggcgcccggcccaaatgcatctttaggaaaattatatttaagctcttcatggagacattaaaaaaccaagctgcattaataataaataattatatcattcattagtaaggagtaaatagctgttttctatttgagaagtattaattggattgtccatctgtatgcaggaacatctgttttctgacatgctttaatcaccatttgttttgtacttgtaccataattacacttgtttgtaatattgaaccgagacaatgattaaaatcaacttatgaatacgattcttttatgcttttgtatttcattagaaaatgtgtaattctggtatgacatttataagtatatataaaagaaagtatttgattaacaaaatgcctcaacagattatgtcagtaaaatgagtgttatatcatgcagtctatgttactattttggcatttttaaggaaagtttattgcttcacggaagcttttttttaactgaccatctatgaattttctgtattctttatttcattgtgatcacatggtcatagaagagacatttttagatcatcagaagttgacagttttcagtgtagtgtatgtgcttagtataagatggaattaagtttgttgtatgggtgattgatgaatttttactgaatcatggataactgctgttctattaatgacatttcatcaattaactcttttggatatggtttatcacaaaatgttgctgatttaatgtttgtggattaactgaggtgaaagtgatacctggtagaagtttcattaatacaaattttcctctcttaggagtaggatggattatattatttgtcgaaatgcctttgcatgtaagttcttaactgtcagctttcttgtcctgtgaatcatatcttttctgtatttgctgaaatagagacttaacattgttaaatgatttttccatgtcatggaaaatgtatgcctctaaatctgcgttccttcctacaaattacaagttcaaaatgactttttttaagaaacaaaaaaaaaagatggatttctcgtattttgtggcaggataagctccctgtagcctatcttaaatgttgattacgactaaaactatgaaaagtacaataagcaactaactgaggaatctgaaaagtaaataaaagtagaattatgagtgataggcaaaatctggagaagcaccctgcagtagtgtgagcttccattgttgtatttctttcaatcaaaaccaaaacaaacaaacaaaacaaataaaaaccagaaaagaaccaccaccaacaagaaaacactcaaggaaaatagatattgtgatagaaacagcagaaatgtcgagaaacaaaaccagaaggttagaattattagagaaaataatataaaaagtaattttaaatatctaaacaaaattttaaaaaggaatttaaaaaaataagcaaggagaagacaataaaaataggttgataattcatttgttagcatttgtctgtttggtatttgttgaccattttatttttaaaaaatttggctatatttgcttttggtgtatttcttgtatatgtattgtaaaatttagtatttattattattaaatattttatattgttaaatgataatttatttttattgataagaaagatgtagttttctggttgttatttttgtaattttacctgcatttatatttttctccatttatttagataatacctaatggttccccacaatgagtggcaattaaattagactctgtgctattttcactttctcaacttctcctgaactatttgatttttgtggcaggatatttcttaatatttgcctttgtgccacttaatgttttcatactattatgggcaaattttgagatttaaaatgaacccattactctcagctattatagacgaggcaatcagggagctaattcctactttcccctttcttttactctctcctcctggttgttacagttgaatcatttgtacattatcagaatcatcagtaaaatatctttttacatcttctacaccatgtatcccttaaatctatatatgacgcattgaatgcttacctcttgccttactggtagtattttacctactcagaactaggttgattgaactttgtcctgtggtaactctcttaataagaactttctgtaaagtgttccctgaattatgggtgcttataactgtacactttatagctgatagatatcttgcaaggataaggataaccatttgcttctcccttctcttctttctcaatatttccccccattttctggtgttaacttttgctgtggaaaactctgatgccaaaatgattttctttttctctaagttgacaatttttgcttaagccctcacataatgctttcttaatctttaaagtcctagtcccatacacagatatatcttggtgttgaacattctaataacatacataagcatatactacacagtaatgtaaatatatgtgcttatgatgatctatcttgtcttaatataggcaataacttttttctaattctatcctatgttttacagtttttggatttttggacggggagaggacttactacatattcttctctcacaccctttacgacccttacattatttggggttcagtctcccttgttctctttacaatttagtttttttttttttttctacaatgattttgtttttaaatcctatttctttcatggattctgccagttgctattgcactttctggctatctcttccccattctcttgcatttcacttcatggtctctttatgttttattacacccttaaaatttatgttggaatgtataaatgttcattccttttttcatctgttttgtagcaacatgtttctagttattacaagagttgatatattccttttttatctttattcttaagagtatttttatgtgaatgctgagaaaattcctttagtatttctcatatgtgaaagttgaatttcctacaggacaaaggaaaggggttgtagaatgtgccccagcctgctagctcaagggccctctcatcatttgctacagtgacagactgttgcctcattttggggacattatggagtcaccgctcgttctccataagagcataaatgattaccaggtagttgttactgtcttctctccttgatactcatacataactcatagcacatatggaagcaaccttctaaatacccatgttttatctttaaaatgttctttgtgtgtagctgcccatttgttttgtgctaactgactgaccctattaccttcagttgtaacaacccatttaaggtagaaacgaaggacactcatctccatgtgttttcagaatttaaatgaaaaaataaaaagaggctgatgtcacttcccagtttaacgcaggggttttatttatttatgtacactcaatcaaactatgactattacaaatggttttaccgctacaataaagatagttaattcataactcaataaaaatgaagagtgaaagattaaaaaaggaaagcaacaattctaaactataaaatctacttcagaaagctacatacagcaaagctcaataaataaattatgaaaaaaagaataatatgggataagttttatggtttaggagataccttcctataagccaaaaacctaaaaaaaaatgctaaaggtatagcttgctatagtacgtggtaggagaaattaacatgtataaaatcaataacactcacattatgtgatagtctacagccaaagaataatagaaagcaagtgaaatgcttagcatagctatttagtctactaaattaggtttgtgaaaatgggaatgccaaatgccttaaggcttatggcaggtgcaaaagcaaaacatcagaggtcaacctaaggatatttttaatataaaattaatgtacctgcattgtaagcattattttttttgtatggtagaaaggaaaaaattcttgtattattctactataaatgtgtattctttgctctactaaatttgcatgtcatcgtcagcctttcactttgtcttcagctaacaagaacctcttgggttcatcctttggagaacctgatatggaaaatggactgaactaggagaagagcctttgtttagaccacatgctgaggtctagtggcttcaattaaaaatatataaatgtggccgggcacagtggctcacgcctgtaactccagcactttgggattctgaggcgggcagatcacgaggtcaggagttcaagaccagcctgaccaacgtgatgaaatcccgtctctactaaaaatacaaaaattagctaggcatggtggcacgtgcctgtaatcccagctactcaggaggctgacgcaggagaatcgcttgaatcctggaggcggaagctgtagtgagccaagatcatgccattgcactctagcctgggacgacagagcgagactccgtctcaaaaaaaaaaaaaaattatgtatatatatatatgcttaatctctaagctttggaaggaacagcctatctacagaaaaatttaaaacttggtcatgacaggtacagagttgggccccattaattttgttgacattgaggtcagcagattctgtaaattttcactatacctctcatatgatctgccgccacaccattcatactcttaactttatttctcctcacaccagtaaattactaaaactgccaagtttttttttcacaaattaatatctttagcattctcctccttcagcctgcaatgaaattatctactcccctccctcctccttcctccttgactcccgctaatgcacatttgtgtttggtttccacaccaaatgagctaccttcaataagcatcccacaactccacagggaacttttgtttctctaccttctgtgctgtcaaagcgcttggctcagaatgagagatctgtctgcatttcagatctacaaattactcattgtgtgaccttggacatatccctaatatttttgagcctcagtttctcaaaaattagaataaagataccaaactcctggggttttgtgagagtaaaatgagacgatgtgtgtaagagactcagtgcagtgtcagtatctaccatgtgctatgcactctgcgttttctttttcttttttttttttttgagacggagtctcgctctgtcacccaggctggagtgcagtggcgtgatctcggctcattgcaacctctgcctcttgggttcaagagattctcctgtctcagcctgcgagtagctgggactacaggcccatgccaccacgcctggctaatttttgtatttttagtaaagacagcgtttcaccatactggtcaggctggtcttgaactcctgacctcaggtgatgcacccacctcggcatccgaaagtgctgggattacaggtgtgagccaccatgcccgggccaacccatagccttttggtcttctctcagccaaggcatccagtgaaaatgcaatttatttttcagattcctctggagaattaaaaagtctcttttgcggctggacacagcaactcacacctgtaatcccagcactttgggaggctgaggcaggcagatcacaaggtcaagagatcgagaccatcctggccatggccaacatggtgaaaccctgtctctactaaaaatacaaaaattagctgggtgtggtggcacaggcctattgtcccagctacatgggaggctgaggcaggagaattgcttgaacccaggaggcggaggttgcagtgggccaagattgagccactgcacttgctctggtgaaagagcaagactccgtctcaaaaaaaaaaaaaaaaaaaaaaaaaaagtctcttttgcatcaaattgccatactctctgctcttggtcctcttttccatgtactcattcttcaagcatttattttctcattgcctgatccagatcattgcaatgaccaaaaaattttcgaatgctatgatttttgtgatattcttttagcaagttaatcacgatgttgcattcttgagtgtgcaagtgtggaggtaagtcaggatgcatctttaagacaaaaagatgggtcacggcagtgccacaccactcacggccacaccaggagagctgaaggggcagtcaccaacgaagatgcctgacccagaagctggctgccagggagccaagagccaggtcactccacaggtggccaatgcccgggggtggccctccaccgccgaagctgctgctgctgctgctgctgctgcttattattattttgagacggagtctggctctgcctcccaggctggagtgcggtagcacgatctcggctcactgcaacctccgcctctggggttcaagcgattctcctgcctcagcctcccgagtagctgggaccacaggcacgtgccacctcacctggctaattttattttttgaatagacagggtcttgttatgttgcccaggctggtcttgaactcccgggctcaagcgatcctcccacttcagcctcccaaagtgccaagactacaggtgtgagccaccacacctggccaagttctacttttctaatatttaaaatatgaaataggccgggcacggtggctcacacctgtaatcccagaactttgggaggctgaggcgggcagatcaccagaggtcaggagttcgtgaccagcctggccaacatgatgaaaccccgtcactactgaaagtacaaaaattagccgggtgtggtgacagatgcctgtaatcccagctactcggaaggctgaggcacctaaacccgggaggtggaggttgtagtgagccgataccatgccactgcactccagtctcggcgacgcaatgagactctgtctcaaaaaaaaaaatagatgatgtcagtgatttctattacatgagatctggaagcactctgtacctgattgctccacgtttagtggtgctaagttcaaataattcaggtggtgagaaactgacttccgtaggagtgcgggtgtgcgtgcgtgccgcggaaatcccgccttctggcgcctgcggttgccccctggcctcagccggtaggctcccaagtaggaagataaaccgcattgcacgaagcgggagagtccagaggagcggcgaagcgctcctcttccccattggctgcgcccacggagccgccttgcgattggccctaagcgcgggtggctggggttgcgagaggcatcaggatccctggcggcgcctgagccagcggctgctaggaggctgtgtccgcaagccagcggggcgaggcgcctgggccctgcgcgtcaggtcccggcctggggcaccggggctgccagcgtcggaggaggtgcgggcgcggggttggcgggcggccgaacgggggcctgcgcggaccgcccgcggctcagcctccggtctctctccgtctctaagtggtggtggctgtgggtttttctgcaggtgatccttttgagtaatttgtttcacgcaggcgccctgctgtagggtaaagcggcagattcatgctgctgtcatttgtcgttcaaactgtgggcttcttggccaggcgcggtggctcaagcctgtaatcccagcactttgggaggccgaggcgggcggatcacgaggccaggagatcgagatcatcctggctaacacggcgaaacgctgtctctactaaaaatacaaaaaattagttgggcgtggtggtgggcgcctgcagtcccagctactcgggaggctgaggcaggacaatggtgtgaacccgggaggtggtgcttgcagtgagctgagattccgccactgcactcaagcctgggtgacagagggagactccatctcaaaacaaaacaaaaaacgatgggctttctgtcgtgtgtgtgtaccttttggatttgagggcagggggatgacattgtgatctggcctcctgagaaaccaggcacaccctgcctaccttggaaggcggctttcccttccccacctccctctccctccatctgttccctctttccctctctccacttcactcccgtcccccagctcttctctcccatctttttgttctctgtctcttttttttttcctgcattaaacctttcgggagtgtctttgtaaaatattaagaagcgttaggtcttcaacatgtgtgtttacttgcaggcctgagacctgggaggaagctggagaaaagatgccctctgaatctttgtgtttggctgcccaggctcgccttgacaccgaatggttgaaaacagatatacaggtggggtttgacatgtctctttcttggtgtatttctgcttccatgtttaaatttctcgtgtaaggcttttttttagggtatgtaaggggaagtcagttgtatcttgctatattagaggagcaggtttgtttcctgtaacttaaaatgtaacagtctttatggctgtttttgtagatcgtgcgcggctgccttttaattagtttcttgcaagtgcaggaaatgagatttattaatagggaaaatttttttcttaattattattactggttgagaaatctgctacactcctaaccatatcatggtgactgttgtttgttactgatagtttttgagctgttgagttaactgtcgaggggaaaattggagaagtaagttgcagtaattatggctgctagaaactcactccttttatgaggtcttgtgtttgtgtttctggagagaaaagagttagttcagttgagctgtttgttttgtatttgtaaccaatacaaggactaaggacaattgtgttgaaactgaggtcataatgttgggatcttaagggccgaaggttccaaacaaatggtatgtatagagttctctctgacttgaaattttccctttctggacctccggatgctgaggctgggagtgtccatatgacagtgccttccatgacaggagtcagcaacctttttttttttttttttttaacacgtatcagtaattcattctgtatattttgaaaagttttaacctcttcttcctagccctccagtatttgttaataaattaaaacgtttcccaaagtgttttttgtgaaacaataattctaaaagatgctctaagaaaagctaagtacatggaaaaatccaaagtgtatattttatttattacatttcatgaatttttgtttctgttttttcctcttgagagggagtcttgctctgtctctcaggctggagtgcagtggcatgatcttggctcactgcaacctccgcctcctgggttcaagcagttctctgccttagcctccagagtagttaggattacaggtgccctccaccacggccagctaatttttgtatttttagtagagacagagtttcaccatagtggccagactggtcttgaactcctgacctcatgatccaccctcggcctcccaaagtgctgggattacaggtgtgagccactgtgcctggaccacatttgatgactttttttgtcctttgttcttttaaaaatcatggttagaaagcagagcataattgttctttatgtagaatccaactgattggggtttttagggagatgttttgacattcagtaaatgtttttgttttccattattaagactatgaattttttattttactttctgagacagggtcttgctctgttgcccaggctggagtgcagtggcgtgatcttggctcactgcaacctctgcctcctgggttcaagcagttctcctgcctcagcctcctgagtagctagcattagaggtgcccgccaccactaccctccgcctttcaggttcaagcgatcctctgcctcagcctcctgagtagctgggattacaggtgcacgccagcatgcccggcaaatttttgaatttttagtagagacgaggtttcaccatgttggtcaggctggtctcgaattcctgaccttgtgatccacccgcctcggtctcccaaagtgctgggattacaggtgtgagccacatttttagtagagatggggtatcactatgttggccaggctgctgtggaactcctgacctcaagtgatcccctcaccttggcttcccaaagtgctaggattacagatgtgagctaccacgcctagccgtattttgtatttttagtagagatggggttttgctgtgttggccaggctggtcttgatctcctgggtgcaagtgatcctcccacattggcctctcaaagtgctgggattacaggcatgagccaccacacctggccaatgggaggtctcgcttcccttctctgcagcattccataagcaatgtgtttgggtagtatgtgttcgattttctctatgtatactttgaaccctacagtagtgaaaggaagagtagacaactttgaagttgatgtggtgtggtctttgagctggtggtgctaattactcttggttgttttcgtggcctccagtgacttcatcctgcttttgctgttgtaaagtgttgtaatttatgctcctgagaataactcttgaggtgtacttagggttcttgtctgcttcctggtgactgtcgaagcttttcatcttgaagaagggagatgagcagtgttccagtgtactgagattaaaattaagaatgttgcatttttttaatatgtaaaatttatagccagctgtagggtaggggtggcctactttctctaaagggccagatagtaaatattttaaggtctcactggaccctatggtctctgtcatagccatgagaccttgcagatttagtgccaaagtagccacagacaataccacgtcagcgggcaggggacgttcattctgtaaagtgtatttatggacaccaaaagatgaagtccacagaatgtttgcaagtcacaaaatactgtttttcttttgattgtttttcagttattaaaaaatataaaatacagtggccgggcgtggtggctcacatctgtaatcccagcacttttagaggctgaggcaggcggatcacctgaggtcaggagttcgagaccagcctggccaacatggtgaaaccccatctctactaaaaacaaaaaattagccgggcatggtgatgcacgcctgtaatcccagctcctcggaggctgaggcaggagaatcacttgaacctgggagaatcgtttgagcctgggaggcagaggttgtgatgagccaagactctgtctcaaaagaacaacaaaaataaaatactttctctgcgttcagaccatacacaaagaggctgtgggctgggtttggcccctgggctgtggttagtgaccccaaacacacacacacatacacacacgtagggcagagtctggcatttagagccagcacctgtgttctcacctgagctgtgttcctggctgggttctgctgtgtattctgtgacccaagatgtctatctaccttggtaaactggagacaacaaagcctgcctccttcaaggttgtttgtaaagatttaaaagggtaatgtattgttgttaggccagatgctttgcatagtacatgttaggttattttcactttttttttttttttttgagacagagtcctactctgttgtacaggctggagtccagtggcgagattccagctcactgcaacctctgcctcccaggttcaagcaattctcctgcctcagcctctcgggctgctgggattacaggtggctgccaccatgccgggccaattttgatatttttagtagagatcgggtttcaccatgttggccaggccagtctcaaactcctgacctcaagtgatccgcccacctcggcctcccaacgtggtgggattacaggagtgagccaccacatctggcccattttcactttccattagctgcttttttcccccattcatttcctacctttctgtgtatgatttctgaattaaatgtatttcatgtcttaaccttctgaattgtttgtcctctcattttccatgctgttaaggaaaataagaggctaagtgagacgtattaaatttgcatgtagtttctcagatcaggataaatgctcacctgttgcagaacgggactctgctcttgcttcacccaggatgcctttcctagttccttcctagagtggggccgcaccctgctccagccctccagacccagctccctgctctgacatgattccaccagactgtattccagctgtcctccctggacctagatattttccttcttcttctttttttttttttttttttcctgagatgaagtctcactcggtggtccaggctggagtgcaatggtgtgatctcggctcactgcaacctccgccttccaggttcaagccattctcctgcctcagcctcccaagtagctgggattacaggcacgtgccaccaagcctgggtaatttttgtatttttagtagagacagggtttcaccatgttggccaggctggtgtcgaactcctgaccttgtgatccacccgcctcggcctcccaaagtgctgggattacaggtgtgagccaccgcacccccccagccaacatatttttattaaaaaacttatatgaaatttattttattgtggtatgtagttcagtaaattttgacctctatagattcatgtaacccccatcatcatcaggatggagaattttcttcaccccaaaagctcccttgtgctgctcctttttatcacgtgttccctggtctcataccctggcaaccacggatctgttctccatcagtatggggtattctttttgagaatgtcatgtgagtggaaccatattttaagtaacattttgaaaccatcttcatttactcccagttatatgtttgagatttatgtgctgttctgtgtattaatagttctttttattgctgaatggtatttcatcatttggatgtaccacatggtgtttatccattctgccattgtaggaccttgtggttgtttccatttttctttcccaattgtaatcctgctgtgagcattactatacagattttatgtgaatatagtttccatttccctaggataaagacctagtagtgtgaaagttgggtcatgtgctgaactgttttccgaagtggctgttttagtttgcattcccactggcaatctgtcacgtttctgttgctctgtgtctttgttagcacttggtgttatcagtgttttttagttgagccattctaacaagtctagtgggatctcattgtggttttaatttgcacttccgtaatggctaagaatgctgaatatcgtgttcttctttgccactcttgtatcctctgtgaagtttctgttcagatcttttgcacggaaaaagctgtatcatggaaccagtaaaataaccaaggagaggttgattaaagttctgtttataaccctagaagattcctgccctagggatatgggatggctgaacgtaggacaccgacactggacagatgaaatagcagtttattagtcacgcatgctcacagccctggggtgggggacaccgcatgccattcagttaatcatgtgtgttgtaacttttcggggagggacatttgcagagactaatggtatgacattctgaaaagcggtgacagattaagaaattttttaattctgcagatggtagtgtcgaaccaagtggaacaaagaaagaagatctgaatgacaaagagaaaaaaaatgaagacgaaactcctgcacctgtatatagggccaagtcaattctggagacctgggtgtgggtcaagcaaccaggtaatctgagttttggcactttggaaagcttgatctgacgctccttttctaaataacttggatggattattcgtattttttggtaacaattttaaaaaatgtaattaaaaaaatttaaatatcgtggtaaaatatacataccgtaaaacttgccattttaatcatttttatgtgtacagttcattggcattaagtatattcacattattgcccagccatcaccaccatccatctctacaacttttgccctttctccaactgaaactccgtatccatgaaacactaactccttctgtccccaggcaaccaccattctacttttgtctcagaatttgactactcaaggtgtctcctataaggggaatcatacagtatttgtccttttgtgactgggttattgaacttcttaggtgtttggggttcatccgcatgtgtcagaattttcttttaaaggctcaatgctattccattatatatgtaagccacatgttatcccttcatcagtgggcaatcaggttgctttcatctcttgactgttgtgagtaatgctgctatgaacattggtttacgagtgtcttgagtgtctgcttttaattctttgtgtctatacctaggagtggaattggtcaataatgtggaatgcttacatatttattttttttgagatggcatctcgctgtcacccaggctggagtgccgtggcgccgtctcagctcacagcaagctccgcctctcgggttcacgcaattctcctgcctcagcttcctgagtagctgggactacaggcgcccgccaccatgcctggctaatttttttgtatttttagtagagactgggtttcaccgtgttagccatgatggtctccatctcctaacctcgtgatccacccgcctcagcctcccaaattgctgggattacaggtgtgagccactgcacctggccaataatgtggtagttagatttatgtttaacttattattgttgtttttgagattgggtctcactctgtcgctcaggctggaatgcgttgatgtaatcatagctcactgcagccttgaactcctgggctccagtgaccttcttgcctcagcctctcaagtagctaggactagaggcgcagggaatttctcatcttctctctactgcctctgagttggagatgtcagagggagccatggcccactgtaaagtaacacaatgtcctcacccacagggttagaacccctcttctggtggcagctctgaggggagcagtcacatgtggagagtgcagggctctgtgtccagctgggggaaggaggttaccaaggggattgacccccctctggccaggtggctgccttctgacacaccagtctctctctctagcacggtggcccctacacacccagcctgtcaaacctacagccctcgggaaggctttggccaaatccatgagcggctccctctgttaagaaggaagcacagctgaagcatgaggagggcagtagagtgtgtatgctccgccgcgtctccccacagtctgaccagaaggaaggggcctttcagccaggctcgcccaggctggggttggagtgtcagtatcaagccaatgtcttcttgcttaatgagtgagcccaggtgctcccgtgcagctgccaccgtagtgagggtgaaccggcaggaggctccacggcactttcaggctcaggctgcctggtgagatctactctgtgggctctgtaggctggtagaggcttccaggaggaggaggggatgcagccaccagtccccactcctgggagtcgtatttctgaaagcttgggtatacagtaaatattaggctgtgggctggtttatctatggatttgatgtgggagggttataggtacaagcagtttaaagatggaaattttgagagaacccttagtgctgggtaaggcaagcaggcttgtcaaagcagctcttttggggaggccagaatcctgtaccaatgtcctcagcatgttcatcagctgctgggggagtgccggacaggatgaaagcacaggagaactttgtggatgataaaatgttccatatcttcaaaggaggtgggttacatgggtaatgcatttgttaaaagtcatcaaaatgtaaaccagatctgtgcatttcacggaatataaattatacctcaaattagaaacatttttaaaaagacagatgggctggatgcagtggcacacgcctgtaatcccagcacttggggaggccgaggcgggtagatcacatgagtcaggagctcgagaccagcctggacaacatggtgaaatcccgtctctactaaaaatataaaaattagccaggggtggtggcatatgcgtgtaatcccagctacttgggaggctgaggcaggagaattgcttgaacccaggaggtggaggttacagtgagcagagattgcaccactgcactagagcctgggcaacagagtgagactccatctcaaaaaaaaaaaaaaaaaaaggttttcaacattcattaaaggcagagtagcttgttatagactagcctccccacaggaacagttagaaaaactggacaaaaatgtgtccccccttccccccaccatcaaaaacaattgttggaaggtaattggggacctcagccaggacttgagtgaccaggcctaggaggtgatcctgacagtccttagtgcttttcccacatttggtgatcggtcaacagtagagggctaagaggctaagaaactgagtatgaagtgatagttaagaggctggagagcctagctgaatgtttggcactctcacagggctgaaatgacataatgagaatttgggtcccagtaaggagatgagaccttggtggggatcctggaagggccacccctaagagtccaaaagaataaaaaatagaccagctgtcacaaaaactaaaacctgctttgagccagcttagtcccaaactagatgaaggcgatctgcttgaacgccaattgtgtgccataaagtcaaagtcagtactctctggaggcagataaaactttactaggcatgccataagacaagacaacgcaagacaaaaggagaaaacaaacaaaaaaaacaatagaaacatacatagatattagagtcctcaggtagaatttttttttttttttttgaaatgggagtttcactctgtcacccagcctggagtgcagtggtgtgatctcagctcactgcaacctcaacctcccacgtagctgggattggtgatccacccgcctaggcctcccaaagtggtgtgattacaggtgcaggccaccgtgcccggccagtattttgccacaatttaaaataaattttctttttttcaagtttgttctcagactgtattcacaaggtcacatggcggcttacacttctgtaggccttgttgaccgttctttttagatactgatgatcttgatctttttcttgtctcctccgtagaagaatgggatgcaggaggtgctgcctaagcctgggcgctcctgggcgttcttcattccagggggcagctgcatgatctgtgcagtgcggttgtcatgggaataacccttcccggcctctcgtgcaggctccaggctgccagggtggctcatatcagaaggatatttggagggagggaggcagggctctgagcaccgctcctcctgcgtcttctcctgctctcccatcctctccttcttctcccgcctcttctccacctgcctccggatcttctcctcctcctcctgcatcttctcatactcatcccacagcctctcctccttgaattgcagcctctccacctgcttccgcatctgctcctcctgctcccccatctgctcctcctgctcccccatctgctcctcctgcttcctcatctgctcctcctgctcccccatctgctcctcctgcttccgcatctgctcctcctgctcccccatctgctcctcctgcttccgcatctgctcctcctgctcccccatctgctcctcctgcttccggatctgctcctcctgctcccccatctgctcctcctgcttcctcatctgctcccccatctgctcctcctgcttccacatctgctcctcctgctttcgcatctgctcctcctgctcccctatctgctcctcctgcttccacatctgctcctcctgcttccgcatctgctcctcctgctcccctatctgctcctcctgcttccacatctgctcctcctgcttccgcatctgctccttctgcttcagcatctgcttctcctgcttccgcatctgctcctcctgctcccccatctgctcctcctgcttccccatctgctcctcctgcttccgcatctgctcctcctgcttccgcatctgctcctcctgcttccgcatctgctcctcctgcttccgcatctgctcctcctgcttccgcatctgctcctcctgcttccgcatctgctcctcctgctcctgcatctgctgctcctgctcccgcagctccttctcctggtcccgcagcctctgctcctgtctccacatcttctcctcgtgcttccgtagcttctcctgatcccgtagctcctcctgatcccgtagctcctcctcctgcctccacatcttctcctgcaaagtgttggtttgaacctcaaaaggaaatagagtcataagctaggtatataaatgtaatctataaaataacggttttcgtctatgattctttaaaaagaaattttaagccgtaaccctgaggttctgatttcccaggcatggtcccaatttgtagatttttagcacactctagaggattctgtggtgggaccagaacaaggacccaaattttccagctcttggctggagcctccccacaccctgcatgatccctagaccatgtcccagccggatgcggctcccacacccccggggctgccgccgctcacctgtggcagcgggattttgtccgtctccagtttcctttttagctccttgatgtggagctggatctcagacttttcagtttctaccagtcgaagtttttcttgtagttcggcatttttctccttcagctccttattggttatgctatggccggaggcagtagagaaaggaatgaacgaagaacagaaaggaccgctttggtgatcgaccctctaccctcgccccacaaccacagaaccgtggcactggaagggaccccaggaattaaaagtcccaggtggcaggccagagagaagacatgagttgcctgaggctaccccatgagtcagtggcacagccggcactggagcttccctgcacacacatgtaaacctgtatgaccccctaccatgctcacctgtaccccccacctcccagcacaccacccacgctaagggctctcagacctcccatccccccctcccctatcctacatgttcctgaacagctccagactcatggcttccctctcctttgttaactccttgatgtactgcaaacagagaaaggtcaagtcaggatacagcaggcagaggagcagctggacgaccagtaacgacagctacactgatactccacagtaacacttgctcctctccgtcacacccgacatgttctcaaggcgtttccaaacccgtggtgtcatttgtttttcttttctttttttttttttttttgagatggagtttcgctcttgttgcccaggctggagtgcaatggcgcgatctcaccccaccgcaacctccgcctcccggcttcaagcgattcttctgcctcagcctcctaagtagctgggattacaggcatgtgccactgcacctggctctcacttgtttttcggagaactcagtaagggtggaaggcacagagaaagagactgaattgatagctggctaacaggggcccagagcgatcagataatattgttattgctattactgttattattaccactgttggaacctttcttgagtgcttcaccaggcactatgctaacaatcccatttaatcctcacagccaccacaggagacagttatcattatcacctctattgtgtagatgaaaaacatggggtattaaaggttaagtgcttgcctaagatcacttagagctgggatttcaacacccaggtatatctgattctctaagcccattcttttggttgggggtaggggcacagataaggaggaggaaattaatcctttgttgatttttgaaagaatgatacattggcatagtccaaacctcagaaggtacagaagggaaatatcttcccccaacactgttcctctctcctgagttttttatgaatccttacaaacatgttttatgtatattaccataatacgtacgtacacacacacacacacacacacacacacacacacacacacgtacatgtgttccctctctctacacaaatggtaacatactaaagatactcttctgtaccttcatggtacaagtaccctcaactccgcctaggatttgaccaaggccacagccaagtatgggtggggtgggcacttggcctccgagctctgtgtccagtgctcgctccccacagcgccccgcaactcacccacagcagctgactcagccccaacctgcctctaacaaccacgcacaaaagcagcaagaaatggcccatgctgtcttctgggcaggacactgcatcctgcagaagggacctttaggctcattcctccatctgcgaagctgggctcccaggggaccgggtaggtggttggactcaccttgtccgccctctcgtgctctgcggacatagcagagagagcccgctgtaactctcctgcaaagtgccaggaatgatgcaggcgggctgccagatccttggaatcttctggaatgagagaggttgagctgcagcccaaaggcctgtgaaagtgccaggttgaaggatgacggggtgcccagattcccaccttcaaatttcctggcagcatcctggctgtcatggagcgctgtctccagttcagttttctgacacataaggattcgtatggtatgatcctgggcctttgggagacaagaaaagcaagtgctgaaagagaagcaaagaaaccttctccagaggacaggagggaacttcacaccctccactcacctctagctgcctccttagggcttgctgatgttggtggcttgccttattttcctatagaaaagaagaggaagacagagctcttactagagggaggcagagatggcacagcaagagacatgcccccagaatggccccactgtcccaggacaggcccacccatgggaccaggttatcagggaccctgtggggatggggtggaagctgggaggtgagccttcctccccaagctgggagtaggcgagacgagactggggcctctacatctgagtgccccccaaacccagcggtcatgtcgtgagcaaagaaagaaaccatgttacctctttcagctgagctcggttctgttgtttctgtggggagagtcaaaggaaggtgactgagggtggtccctcgactctattccccaggccaggaagcggtaggcaggggtcaggaatggattttaagggcaaagttctcagacccaatgggaacacaaactggtcaactttccttaacgcccaaagaaaaaggatttgggtctttgttggcttttgcccacagccacagaactgaaagtctgaaactagattctctggaaaagacagtaacataaaccttccgacataagagtgtgagaaaagcccacccttctgccagcttgtgatggagaaagatgtgttcattcaacaagcattgagcaagcacataggggccggggacggttcttcactgctgggatataggacggaaaaggcagacaggagcccttggccccaaggtttccattctagtgaatctttaaatctcagactctcagagcaaacagaacctctgatactctaactctacctcctcaggaaacggaagcccaaagaggaggggagcttacagcaggccctggactagggattaacacaaaaacaacagcaacaaatctgatttaagcttcacacatgtaagtaaaacattaccatccccattttacagatgtgaaaagagaggcccaaagagctcgagcaattttccctaaaccgtgtccctcgcagttggagagagaagtaggactcaaacccagaattcttagccagtacccagcagttcttccttccacaatcttaacagttaccctcgacctcccccttgtgccccttgtcctcaggagaccggccagccaagactcacatcctcaggcgagtggcagccccccgaagtggttgtctcagggttagcgccatgatttattttcttctttttggtgtcggttgctccggtaccaacaccagcactgttccactgatgatagtctgtaaactgtggaaaagaggagcagtgatactcatgagaactacaagctcctacagtcactttacagtttatacaaaatactctcatagacgatctgacttaatgccaccaacgactgtacgaggtgttgtcgcaatcacttagtgactgagagggattgataccatggctaaaagaaaggcaataatggaactgaaactcagtcttctgactctgagctctggggtgttgccacaaatcagcagctgccagagaccaaaaccagaggcagaggtagaaaagtaaaaagtaggcaggaaggtgtacactgtgtggtttacagtcgtacatcctcttagagtcatgtatcctcagggcagaaggcagcctttctgttaaatgtgggaattaaacagaaagaggacaacccaagctgcatttcagagagaagtcttgtatactctttgaaatctatgtgactatcatccctaagaacattaatgttttgtgtctcccacgagaatcaaggaaaactgatgcttcagaaagatgccccatatgtatcctgtggcactcaaagtaccccaggttgagatgagatgaggaagattcaagttgtcaagtccagtttcccaagatctcttgcacagaagatgagcaaatctcacttcaaagatcactgactgatgggcactctggtcccagaaccatggagaattcaaatatgaagtggagaacttagaaaaaactgttaaagtctctctggagagtagaagcctgggagaaaaccaaaccaaacccattatcccatcagtgctgtgcccaagttgcctctttgagattggcatggggtcacagggttgggacccaggtacttggagacgtgagcccaaagagcccagggaagtcaggcttggggcagcggtaggtgagggccgagtatggagtggggagccccaggagtcacctgcccaaagtcaccctggggtgactggtgagggcaggtgctggggcatccggttccttgggaacgtgagcccgaagggcccagggagatccatttttggacaataggaggtgagggcagagtacaaagcagggagccccacgagtcaccggctgaaagtcaccctggggtgaccggtgagggcaggggcaggactgctgaggggttggggctgacacaagattttggttgggggagcccagaggcactggggggggcccggccctgcgtgcctctggagtgacacggattctggcagctgttctgccatcagaggggacctggggctgggttggggttggggtgctgcaatccgatgcgttttacctttttcttggtcccagccaattttctttgttgggttttttcggacatcatggggtggggagggtggtggggttggggtcacattggcgtgatccaggcgaggacagtgatatgcctccagtcacgtaccacacagctatgtgactgagccacaggaggcgtcaccggggctgcactagaatgcggaaaaggggcgtggccttaatgctccaagcccattggtcaatgagaaagatgaaagggaaaggaggcggggccaggcagctgcgggtcatgaaggtcctgtgatgtcacaaggaaagcctcccatggaactgctgtccccgcccactctgggagaggggcggggctggctttcacttacttttttttttttttacatatataactttttattataatttaaggtatagtcgataatataatgtttttttttgttttgttttgttttgttttttttaattgatcattgggtgtttctcgcagagggggatttggcagggtcataggacaatagtggagggaaggtcagcagataaacaagtgaacaaaggtctctggttttcctaggcagaggaccctacggccttctgcagtgtttgtgtcccggggtacttgagattagagagtggtgatgacttttaacgagcatgctgccttcaaacatctgtttaacaaagcacatcttgcaccgcccttaatccatttaaccctgagtggacacagcacatgtttcagagagcacagggttgggggtaaggtcacagatcaacaggatcccaaggcagaataatttttcttagtacagaacaaaatgagaagtctcccatgtctacctccctctacacagacacggcaaccatccaacctctcaatcttttccccacctttcccccctttctattctacaaaaccgccattgtcatcatggcccattctcaatgagctgctgggcacacctcccagacggggtggcggccaggcagaggggctcctcacttcccagtaggggcagccgggcagaggcgcccctcacctcccggacggggcgactggctgggcggggggctgacccccccacctccctcccggacggggtggctggccgggcagaggggctcctcacttcccagtaggggcggccgggcagaggcgcccctcacctcccggacggggcggctggccaggcggggggctgacccccccacctccctcccggacggggcggctggccgggcgggggttgacccccacctccctcccggacggggtggctgccgggcggagacgctcctcacttcccagacggggtggctgccgggcggaggggctcctcacttctctgacggggcggctgccgggtggaggggctcctcacttctcagatggggcggttgccaggcggagggtctcctcacttctcagacggggcggccgggcagagacgctcctcaccttccaggcggggtcgcggccgggtagaggcgctcctcacatcccagacggggtggcggggcagaggcgctccccacatctcagacgatgggcggccgggcagaggcgctcctcacttcctagatgggatggcggccgggaagaggcgctcctcattttccagactgggcagccaggcagaggggctcctcacatcccagacgatgggcagccaggcagagacgctcctcacttcccagacgatgggcggccaggcagagacgctcctcacttcccagacggggtggcagccgggcagaggctgcaatctcggcactttggggggccaaggcaggcggctgggaggtggaggttgtagcgagccgagatcacgccactgcactccagcctgggcaccattgagcgctgagtgaaccagactccgtctgcaatcccggcacctcgggaggccgaggctggcagatcactcgcggttaggagctggagaccagcccggccaacacagcgaaaccccgtctccaccaaaaaaatacgaaaaccagtcaggcgtggcggcgcgcgcctgcaatcgcaggcactcggcaggctgaggcaggagaatcaggcagggaggttgcagtgagccgagatggcagcagtacagtccagcttcggcacagcatcagagggagaccgtggaaagagagggagagggagaccgtggggagagggagagggagagggagaccgtggggagagggagagggagaccgtggggagagggagagggagagggagagggagagggactcactttctaaactttaaaactttatcaccttagttgaggtacaaatcctgttgtaatggaaaatttacagcgtgcttaatgattagtaaagcagattatattatccaacattccaataagataaaataatcacagtgatttctcttttttggaaaaagtttctcttattctcctacattattgttaagttttttttttttttaaactagagatatgtctaatatattttaaaacacaaagcttttgaggtgggtgtggtggctcatgcctgtcatcccagcacattggtaggctgagatgggcatatcacctgagatcaggagtcaagaccaaaattttagtattttagtgtgtattttagtatttattttagtatttaatacatcatttagggctacatgtagccacagaaagaataaatctgattcagtgacttaaagaaatatagatttcatttttgtcacttaaaacgtgcagaggaaggcagtccagggttcttttcagtttcctgatacttccttagcctggtttctattcttgtggtcacaatgtggctgctgtttttccaggccttggattgccttccaaggagggaaagatgaaaggtcaaaaggctgagtttgtctctttttagctgaaaaacacagatttctcaaaagttgtaaaattatactgcaattcaattttcatccttttttttttttttttttttgaaacgcagtcttgctctgttgccaggctggagtgcagtggcacaatctcggctcactgtcataatgtccgcctccatggttcaagtgattctcctacctcagcctccctaatagctaggaatacaggcgcatgacaccacgcccgactcatttctatttgtatttttagtagagacgagatttcaccatgttggccaggctggttttgaactccagaccttgtgatccgcccacctctgcctcccaaagtgctggaattagaggcatgagccactgcgcctggcctgcaattttcatcttttggctgcaaataagttatgtcactattctcagctgggggagtgtttaactcacatgttgcttcctctctgttacacaggttttaagatttatgaataggtactgaattgtatcaattgcttttttctttcttgattgagcagtgttttttcttatctttttatgttgataaggtaacttaacagtgattggcttttgaatgttgaacattgcattttggaattaaatcaactttgttgtgataaatgattaataccatattatatatggttgagatgggtttgctcctagttcatttggtagttttgtacttacgttcacaagagaaagtggagtctaagtttttctgtgtgttttttttttttttttttttttttttgccacggagtctcgccctgttgtccaggctggaatgcagtggcatgatctcggctcattgcaagctccgccttccgggttcacgccattctcctgcttcagcctcccgagtagttgggactataggcgcccaccaccacccctggctaatttattgtatttttttagtagagacggggtttcaccgtgttagccaggatggtctcgatctcctgacctcgtgatccacccgcctcagcctcccaaagtgctgggattacaggcgtgagccactgcacccagacttgtgaggttttaatatgaagtattaaagctatgctggttagacaatttgagaaatgtttcttctcctatttctgacagagtttatgtaagatgtgtgctatttcttccttaagcatttggaaagaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattctcatgaacactcctcaatttggagagagagggactgtgatgaggggggttgagatggtacccagagcctgatggccctcaccagcttcaggagaaacctgctcccctccagggctccttcctagggtccggcttgcactgcattctgggagaatcctgtagccccatcttccctttacccattggccgtttaatggtatcccattctcacatttagccttttgaatgaatcaaccaccatattaaaaaattaatagatttaatttttttttcagcagttttaggtttatggagaaattgagcagaaagtttagggagttctcctgtacaccctcaccccatttcccctgtttcctcattattaacatcttacattggtgtggtacattcgttaccattgatggggcagtattattattaactggagcccatagttaaaacatattggggttcactcttcatgttgtatattttatgagttttgacaaatggggaatgactcagctaccatgtctttgttttagtagatcgttagttgctttttgtcttattagctgactcttgttttgaggagaactttttgtcacatccttttgcaccccggcttactgtggcgtggggcaggggtactgggggccagctggtctctggggagcagcactcactgcatcctgcccccgccccattctgctcctttctggtctcagcagcctcccttgctcctttcacctgcctaccccagctcagctgcctgctgcttagatgccactgtggggcaaggaagctgcccccagtcggtccccgaggattctgcccagatagggataagaatcaccgcgagtgtttgctgagcacttgggaggcataggctcggcgggaagggaaggcctgcaggctgaggtggtctgctttgagttttgcagcgttgcctgcggtctccgtgggtgagggaaaaggcacagggaggtgcagaagcgttcctggcgccacggagccggtcagtgacagagccgggtctcaacccaggccactgccctcggcagccaagccccttctttattttggaatggccacctggccaactggcacacagggagaactcatgaaaggaggcgtggctcactcctgaagggagagggacacaggagcagccttgatgcgcaacgccccctccaggccccgagtccctgtccttggaggaagcaggactcccaggtgggagaggtgaagcagatggcttcccccactgcaaggaggaatcccggtgctcttctccaccagccttccctttggtcgccccctggcgtccgcgtcattgtgggaacactcgggcgggatgtattttaaaggagtgcctgatgcgtgtgggtgtggtggggttgggggtgggggtggggctgggggtggttgcagcggggcctatgcaggatcccggttggagggggctgcagaggctactgctgggcctggtgtcgccatggcagctggagagcgggcgaccggtcgcttggcgtcctgcttggggttgttgcccacatcaccgagcgaacgttcctgtcccgcccactcactgcgaggctgggcagggccgcttgccagttaattgtggggattattatttttttttttttgtagacggagtcgcgctctgtctcccaggctggagtgcagtggcgctatcttggctcactgcaagctccgcctccagggttcacgccattctcctgcctcagcctccggagtagctgggactacaggcgcccgccaccacgcccggctaattttttgcgttttttagtagaaacgaggtttcaccatgttagcaaagatggtctcaatctcctgacctcgtgatccgcccacctaggcctcccaaaatgttgggattacaggcgtgagccactgcgcccggccggttgtggggattatctgagagttgctggagtgttctgcacttccttgcgaaccttttacctgggtgggcagggggagaggccgagtcaagggaaggaggcaggatgccacacacgccctgcagggagagtcatctgctgggcactgcgacacacagaaagccaggagcctgagccccgcccgcggttgttgaacggagggagaatgaacaaccgctgacttcctggttcctgggtgccgcatcactgcccctctgctccgggtcaaaccggctgtatgcttagcttcaggaacatgtggcaggtggcagcccccggccccgtggcaggtaacggtggttttgcagtgtggcgtgctgtgggggccggcaggggcacagctgggcaggccaggctttctctggctcagtatgcagggctggttcttcccagaggaggcagaggtcagggaggagctctttccctgtgtctcctgaacagcttcatcagcacaccctgcagcggggactcagtgagcatcctgcagctgtcttgtcccagaagggctgtgtacttttggccctgagggcaacctctgcatttcctttctgggggctcccagatgagccccgctcccccaggtcatcctgatccatattgatgtgataaccccctcctcagtccgaaacatctggaggccccgtttgtccgtgggataagaatgggcttgagcatggctgtgggtgctccgtgtggcgacagtggcatgttctgtggcagcttgcttcctctgtagcccgatgtctttgactcccagcccgatgctccctcctcacccagcagaggcccctcctcggcctttgcatttgctttcatttatcttccttctttaaggctgcttttgagggtttactggccagcagcatcatgtgcagtctataaactgtgtgccctctcggggccaggtaggagcctgagagggaatgggagaagtggtcacgaatgattgtgaggactgcagaaagaagacagggctgagaagagtgtgatttcccctagaattcagagatgcctgcaccagctgggttttgaagaatgaataggagtttgccaggaagattctagaggaacaacagcaacaaaaagatttaaacatgggcacagaagaggtgaggcacagatggcacagggatttggggtgtgatggggcaaggaagccatgggcagggtctaggcccaggacctcaggtgctttgcatgccatgacttggaggcaatggccttgtcatgcagaactgtgcctccctgggccccattagagtccctggctcttggtgtgcctttcatgcccacaccacggtaggagcaggcaggtggggtttggcctgggtttccccaaaatggacactactccttcttgtgcttcagtatcagagtgggcccgtggagtgggaataaatgtttgggtttaggaggcctccagctgggtggcctgctcccaggcaggaaacacagattagaggaagtatcaagttggaaggcagcagccgtggatgttaaagctggaggaacctcttaaggaatggctgtcagctccctcgtttggtgtggtaggaagatgagggtgagaggggttgggagcaggtgctggagctggagcctgaacccccatatctcagtgctgccatcatccttcataataaggaaactgaggcacaggcaggttacatagtcttctcaggatgtcagtggcagagctaggacgtctatctctgcagctcagttctgtgcgaagtccaggcagatggtgctgatcagtaaggggtgctggctgagcgctgatggccacctgcatctcaaggagaaacagtgtcactggctaatctgatggcttctctgggcaccagcacgtgggcaccatcaccctttctctgcagggggtttgtttagtgtatttggtagaacatcccccagcctactaggtgtggcatgctctatgccacaagctctgtatctcaggcagcattttgtactttgaaaaaacaagttgggaacagaaccctgatgaatgtgtttcatttcctgtcagagcaaatgaaacctgaaatattaatggcacgagatttcccttatcttcctacaaaatcttcctacattgaaaaatgtactccccacaagcttagcatgcagctctgctacctgtggcccgaaatcattagttgtccatactcactgacctttggaaataaacacgaaggttcacttgaagacttgggggagaatcacggtcaacttgtgacgcttggtttttcagatattcagctgctctggagagccttggagttccagctgctctagaggttctggggagggagctgttagcctcccatatgagcgtgtggcccatcgttgccatccacacctgcccctctgtgggtgaataagtggtttcctttctcagctggttgacgcttcatttgtttgtgttctttttctttacagtctcctgaatatttacgcgttgctgaatctcctgtggacaaaccaccaataggccaggactgtcctgtggacagacggggtgagcctcttcttgtgtctggagattctgagtgagtagaacccgttatgatccccactgcacttaatgtggcattcatgaatgagtctgggctgatgtgctaattgggggccgtaagaagagttatagccacgatggccctcacctttctctaataaaagcttaaacacagctacggtaaatatttttgctttctgctttcacaaacttcacatacgcttacatttattttgaggcgaaaggggaagaacagacatttacaggggaccagttgctaggagaagactgtgcattccctgtaaccctgtcagtctcacctcggagatcctgtccctggagtgccccaggtcccttttcccagctgcactgagtgcctctgtcctcctggtggagctgtgctgctttcttgggcagcctcccttccccatggggtgcacataggctgggggcatcccggtggtcagttcttcccagggacccaggaggaggggctggcagaaagtgggcaggttctttccgctcgacctggcaataacaattcctaaattgctcagcaccccaggctgcttgccttgacccaggtagccagtcccaggcaccaccagtgtgggcagggccctccccaggggcagcagcagggcagcccaagacactggtggccaccacagttagtccccacaaggcgattgtgcaggacatgttctcgagctgcctgcagggtctggttgtgggagcagctcagcccctcctgcagaggtgggagcatcttctacagccagccattgtcccgcaggagctctgtgcccagtggaatatctcagtgcagtgcacaatggggccacagctgtgtcacagccatgctctgtcctttagtgggccgtctgagccacattccacctgcctgttctgacacactgctctccctcgatgaccctgctcccactggcctccccatggtttcgatctgtaacccagaccctgttcccaggagctggctcagcaccatcctgctccacaccctctctcaggagacatcctaacctgcccagcctgtcctgttcctgcctctcaacccagaacactgcaggtccttcaggtattcggtgagaccttagaagcaggcacagcaggatttatcccacatgcaccatgcaccgtgctgaggaagccacggtcactcccctaatggtcactagaggtgagagaactgaggttgttgcccatgtggtagaactggaattcagggcctcagccacacctcagtcaccacaccacgccctgtgcaggacgctggggaaaccaggcagctaggactggcctgtgccttggaatgcttactcagaccacccatccttgtcccctttgcacctcaaaggcttggtctacttttcagacacagtttttatattgtcagcctgatacatatgcatattttaagatgtcaaagagttttataagttttatgaaaaaaatagcagacccctggcctcccagaccatctccccaccgcccctgccctgcccactccccatagattaccacttccagctcttattgcttcttcctctggatttatctccacatttgtaaagaatatgggcacgctgctatttcttagtcttctgttgtggtcaagatggttgaactcgtagatttccctcctgagagctgctccatctaaccctaaccctaactctgatatatagagttatgtcatcatttaggtgaacccttatgcagtgtgtatcagtcaggataggctgcctcatgatgcaggaacaagcatccccagacctgagagagttccgtttctctagcctcctgccctgggggtgggtgctgagtctgggggaggtgtggggtggggggaggggcctcagcgctcagcagacaggtgctcactggtgtcaccatgttccctgccctcttctcatatggaacacgtggtgcccttttgccagggcatccctgctcaggggtcaggatagtcctcctctgagtggctgggagtctgactgctccctgtttagactattgagtagccccctgctttctgcctcactccctttttgtgctggtgtctcagtgcttgggccttttggggttttagaggtgggccgtgaggctgggcatgaaaaggcttctctgcctccaccgcccccccggggctcctcatccctgtgctgcctcagcacttcgtctggcaagatttgcaggtgcagttttcatttctcattctttgttggttttgagtgatttcaagagaagatgcagaaaggctgtgaccccacctctaaaagccagcggtcaacctggccacccttaagcctgttctagtgggccccctgccccgttgccctgctgtgacagtgtcccacgaggacagactcaacacaggacttcagtccttgccttcccgagtgctggcagccctggtgctgttgctttccctctcccctccttgttctcaacctcaggaggaaaatgcccagtttctcatgatgagatatgatgtcatctgtaggttttttttttaaaaaagtgggtaaaattcatataacattagccattaaccagttgaaagtgtgtaattcagtaacatgtagtgcatttgcagtgttgggcacccactatctgtgtctagttccaacaagttttcttcatcccagagaggaactctccattaagcagtcactccccagcctccctaccccagtctctggcaaccccaatctgctttctgtctccatggacttacatattctgaatgtttcccataaattagacatcatataatttgtgaccttttctttctggcttctttggcttagcatgaagtttatgtggatgacccatgttgcaacatgtgtcagaacttcagtcctttctaaggctgaacaatattgcattctgcagatacaccacatttgtttgtgccttcatttgatgggcgtttgggtagtttccaccttttgactgtcaggaataatgcagctgtgagtgtgtgtggatagtgttagattcggtatctgttttcaactcttttgtgtatgtatttaggagtggaattgttgcgttctgtggtgactctgtttcacttttccaggaactgccaaactgttttccaccacagctgcaccgttttacattcccgccagcactgaatgaggattctcattttcccccatcctagccaacacttgttagtttctgttttttgtttctttgtttcatgatggccagtctatgggtgggaagtggggtctgactgtttattggcatttcctgaataggttttttggtagatgttctttatcaagctgaagatggtctctgcctcatttagtgagtggtttttaatcagaaatggttgttggatttttgtcagatgctttttctgcatcaattgatctgatcatatgattttgtctctttagtctgttgatgtggtagattatatccattgatttttctaatgttgaaccaacattgcagccttggaaaaaataccacttggttgtagtgtataattctttttaaacgttgttagatttgatttgctaataatttgttgtggatttttaagttgtttgctcctgagaggcagtggtatgtcattttcttataatttctttggttttgatgttaggataattccagcttcataaagtgaggaagtgtttcttcttttccaatttctggaataggttgtaaagaattggtgtaatttctcccttaaatgtttggtagaattcaccagtgaaatctatcttccttttactgatttttagtttaattctattgtagtctgagaacatatttttatgatttctatttttaaaatacttgttaaggtgtacttcatagctcagaatgtggtctatctttgtgaatgttctgtgcaagcttgagaagaatgtgtattttgctgtagttggatggaatattctataaatgtcaattctgttgagttgatttatgatgctattcaagtgaactgtccttgttgattttctgtctgcttgttctatcaattactgacaggtcttgaagtctccacttataatagtggatttaccaatttctcatttagaattaaaattctctcagattttgccccatatatttcaattatctgttgttaggtgcatagcctttaaggattgtaacatcctcttaaaaattgatttttctctcattatgtaatgtcgcctctttatccctgataattttccttggttggtagtctgctttgtctgaaattaataatggtactccaacttactttgattagagttagcatggtatacctttctctatccctttacttttaacctaccagtgtctctgcatttaaagtagatatcttgtagatagcatagagttgagacttgtgttttttatccactctgaaaatctctgtttcaatgggtgtgttttgatcattcacatttaaatgattattgaggtacttagattaatatcaaactttttagtaactgtcttctgtacttgccagagacttctttttctctctcctctggtttcaatggaccattttatgtgatgccattttatctcctttcatagtgtatcactcatacttctttttaaaagttttacaatatatgtttacaatatgtatttcaaaataatctaagcccaccttcaaataacactatacctcctcccatttagtacaactaccttataacagaatactcccaaatcctccttcctgtcccttgtgacattgctgttaattatttcaattatccatatgtcataatcatacagtatatcgttaccattattgcagtaaataaatttatttttatatcaaataagagtaaggaaaatagaaaattttatttcactgtcatttattcctttttgaatacctcttttttatgtagatccaagttttcaacctatataatttttcttctgtatgaagaaaaatcttttaacgtttatttcagggtatatattgccagtaatgaattcccttggttttgtttgcctgataaactatttctccttcatttttgaaggatactttttctgaacatagaatgctaggttggtggtttcttctttcaaaattttaaggatttcactccactctctctctctctctttttttttttttttttgagacagagtctcgctctgttgcccaggctggagtgcagtggtgctatctcggctcactgcaagctctgcctcccgggttcatgccattctcctgcctcagcctcctgagtagctgagattacaggcgccagccaccatgcctggctaatttttgtatttttagcagagatggggttttaccatgttgtccgtggctggtctcgaactcctgacctcaaatcatctgcctgcctcagcctccccaagtgctgggattacagacgtgagccaccgcacctggcctatccaccctcttcttcctttactggtttctgatgagaagtgggctgtaattcttatctttacccctctatagataaggtgtttccctaccccgctggtcatttgccttagtcattttctctgtctttggttttctgtagttcaaatatggtgtgcctaggtgtagggtattttgctttttgttttttttttgttttgttttgttcttagtatttactctatttggtgttctttgagcctccatggtctgtggcttggatctgtcattaattttgaaaatattttggccatcattacctcaaatgattttcttctccattgtctcttttgttcccttttggtattccagttacacgtgtaacatctttgatgttgttccacagttcttggatactttgttctgttcccctccccaacccattattattatttttttatttttatttttttgtagaggtgggactttgccatgttgcccaggctgatcttcaacttgtgagctcaggtgatccccccgcctcagcctcccaaagtgctgggattacaggcatgagccgctgtgcccggtcttcccaccattctttgtgtgcatgtgtgtttcattttgagaagttcttgttgacctgtcttcaggctgattattttcagccatgttgatgagcccgtcaaaggcattcttcatttctgttaataggttccttttgggctgggcgcggtggctcacacctgtaatcccagcactttgggaggccgaggcgggcggatcacctgaggtcgggtgtttgagaccaatctgaccaacatggagaaacccctgtctctattaaaaatacaaaattagccaggcgtgatggcgggcacctgtagtcccagctactcgagaggctggggcaggagaatgacgtgaacctgggaggcggaacttgcagtgagccgagatcactccactgtactccagcctgggcaacagagcgagactccatctaaaaaaaaaaaaaaaaagaaacatgttgtcctttttgtcttctagcatgccttgtaagttatttgaagctagatatgatgtatagggtgatgggaactgaggtaaacaggcctttaacgtgaggttttctgttaatctggctatgggctacgtgtaatgtttgttgtagctgtgagtgccggcgtattccgatccttgcagtgcccttgtttttgtcctctggctctgggcttccctaaattcccttcctcagacagagtgagtgtcgtgcagctctcccagctttcacctgctgttgtacactggagtcctgttggtgtagttgtagggtgtggggagggccagcggtctatagtcttctgattacatctcagtctttctgtggtcccatttccctgggctgtgactgtcacagatgtttcttcttatatagcttttccagaccccaaacaggaggccagagggggctggactcaggaatgcccttcctccgtggctttgcaacaaggttctggtaaagtctttccctgcggggagcaggcctttgtcctagagaaggctctggatgcatttcaccaggatgacgtttgtcctccctctgccagagtcaccaggagatgtctcttgggttttcatggtgagaacctagtagggatcctggaggaaaagcccatgaaagttttgggcccccctaagactgtggcttctaggagtttctcagtcatgggagtccacccttggcctgcagcaatttgtcagaattacccaaactactgtggtatggccctggaggctctgttccaggtcagtggatctttggatttggctgtgtctctagatttcaggggggcgggttgcaaactcaattcactgatgagtccaaagaaggtcattgattttcagtttgtgcaccattttctagtcatgaggatgggagtgatgacttccaagttctttacgtgttggagcggaaactccaatccttcccctgctttgattttcctgttaccctaaccgggaatcatgtttgttatttgatggtttactcagttgtcatctgtcttcctaattaggacataagctccagggaactggagtgtcagtgttcccttgcgtccttgcacccacaagacagcctggcacattctgaatgaatacaccgaaagggataaataacgaggccaagccacctggctatgggtggctgctaatccgtaggatttctcgtgccttgtggtttcagtgaatttgcgacacacatgagtgatgctgccaatgggaggctcccagatgtcctcaacaaatagaggagtgaccactcagatccaagggtgtagcacttcccgcctatcactgggagctgatgggctgtctttagcatggcactttgtatggtgctggcgcccaggcttccctggggcaacagcgttggcccaggcgacacacaagaagaagggggtttttctgtggtcacttccgcgttgctagttgttttgccctcttactgtggctaaaccttctgtccatacctgtcccccattctcagtatttggcttttcggattgcagtagtgggacttgggtgcacattgcaataaaccaatttgcccccattatccatgtcttgttgatggtcccactgccagcatcagttcttatgaacagatttctaaaccatcaccatctgttctgctcttaatttcaagtgtaaaaagtattactttcctaattccgtcaaggggagggagaatatgtattcctaaagaccacagttcttgtatgaggaagtgtagatctgccacccacctactaaaggaaaggttgcttctgcccatcctcaaagctgttgagcagttatttacctagagggtaaaactggcccattcgcatctctataaaaacaggtaggaaaaggtggaaggagctgagttggggaggtggaaggggggcaaaagctatgtctcccgtccctccctgacagtgcagccccccaaccctccagcccccgccagtataggtgggaatgggctggcagggctgcattgtggtggtccctgctgctgctagggctgtttccagaagaaggcccagtttcaggcttgacttcccctcagaagtcataaggaccataaggtccatctgggtgggcgctgagctctccacgatgggagcaggatagacatgagcatcttcaccctcgtggtccctctgagcctgccctgggggtgagctctttttctgctcaaatgaacattccaggcaggccctggagctttctgtcgttctaaggcaatagaaggttctttggttactttcagtcccaggaacattgttggtcagtcatgaaaaggagtaattatagactctttggagcttctcccacccggctggagcctgacctgtcttggagccggctggggagggagggctgtgtgtctccttctttctttctttgcctctgtttttgctggccagggagtgttccgagggatggagtgtctggggagagggcattctctccacaagtgggctgggtggcacttctggggtccagcagatgtttcacttggacttcctgtctccagtgaccctcgggtaggtttcttagagatgaccctgctgggaacttgcagctcttccctgcgacctgtgggaggccttgctgggctgatgcccttgactgctctccctatcctccaccatgcccctcgggagtgctcctgggctgttccttcaaggcggccccaggctggccccacactggtgggagcagcaggcagctcctccttgggcagctcctcctcttcccctgtgaggcagctctggtcatggcctcctgcctctggattctcaggaaactcgggtgccgcgtccgcagacattggggactcggtacagctatcctaggggtctgctagaagccctgtttgggaatcatggtgaagccacctccccagccccctccatgaggcacagcccttcacggaaagtccctgctcctcttctggtaccccgtaggccagaaaccatgctggggtggggagctgggagcatctgttgatgtgggatgcaggcgtgcttgtcacctctcctggccctcagggcagcaggacagcttacatgaacatctcatcccgctgctggtggcctctggtgagagactactccagtcggtccccctgtagctcctggatcttagcgggggcctgggaatgggaggccacaaggaggttccagagctaactaaagccgctgagactcagagggagtctcacgccactgcctcctgtgcccccatcccctagcaaagtgggactgatgagggatgaccttgcgtccttctcccctgttcactgggacctggtgctgttgccaccgtgggcccaaacatccactgcccttttagcaaggcagcgctgctccatagggtccagccggggaagcatctggctttgcacaggtggaagatcatgactatttccagagtctgttgccaggctccatgtagttcaggagttgtttctccctctgagagtccaaagtggttgttttccggagtttggcagtacctaagggttaattgggatgttattgtctgcatttggcttagagataggaaagttttatgtttattcaaattatcagtaatttaaaattacaattttagtcttaattgtacgtatttggagatcccatttaagtctttggaaataattgcagagtaatattttgggaagttatattacaatgcacagacgttcaagtggagaaaggtccctgcgtgtgagccttggcctggcagaggggcatccaggacaggatctacagcacacagccctcccaactgggtctgggcatggctgcagctgagtctagccctcctttctgtgctgctgcatcccaggggatacggccacacaggccacagttgcctagaccgacctggtgtcaggatcactgtctctgctttggtaagatgtccttgggaggggaagggagccagccaatgagatgaggggtaggagggtgacagggtggagcagaccctcatgctggcagaagagaggttcacattcaccagggagcaggtttttctgaaccctggagagctgaggggggcacctggagcacccctgcagtccacagcatggggtgctggcttctgtactgtagtgcagtgccatgaggtacccatcccttgcagtggggtagggtttaaaacccagaaggcagccctccctggagcacagccccatggtgtttagagaccctctcctctgagcacatgcaggatgtgacaatgcaggtgggcctagtgctgcagtctcagagacacccatgggcttctgccatgctttttatccaccagggcagtaaaagcaacgtccacagtggcttagcctcctgcaaagcctgtggcaggacagccagggttccctgacagtggagatggtggacggccccatagggggttggtcccatctcgccagcagaagtgacctgtgtggccttagtggtcagtgctgcctattgtgatagtggattgtttaaagccaggtcccatcgtggctcctgagggaatgaaaatgaggggttctttgctgtgatctgatgcttgtgttccaccaaatccatattttggaattcttatccccaaagtgatgggacctttgggagggagacattggaattcacattcccaaggagatggggccttatggaggtgtcttaatctgtattctgctgctgaaacagaataccacagattgggtaatttataatgaacagaacattatttggctcagagttctaggggctgggaagtccaaggttgagggttgcatctgctgagggccttcttgctgcgtcctaacatggtggaaggcatcatatagtgagcgagagagggaagggggccaaactcattgttttattaggaacctgctcctcagtcactaacccactctcgcgataatggcattaatacattcatgagggtagagctttcaggacctaatcacctcttaaaggtctcacttctcaacattgttgcatcggggattaggtttccaacacatgaactttgggggggcacattccaactatagcagtgggtgatcaggtcctgatggtgaagccctcataatgggatcaatgccgttttaaaagaggctgcagagagagcctcccgccctccaccatgtgaggacagagtgagaagctgccgtctctgagccatcacgcaggtactcaccaggcacggaatctgctggctctctggtcttggacttcccagcctcctgaactgagacaagccactttctgtcatgtataatctacccagtttatggtattttgtgagagtaccctgaatggaataagactcccttcaaacaaatgtcctgctctttgaaagagagtgtggggctcacagtctgctagtaaagacagttgtaggagcaatggcaagcccacactggctcggattttcagaccttatcattgagttaggagcgaagtcctcgacctgaggttttattggtccaaagtcagggcctgctggagcccgacaggttgcgtgcttggcctgtggagcagttttctccagagcacctctatcccctctgccttgtgccaggcccagcagggactgagggtagaataatgacaggcacagctcctcccctcaaagagtccactatctggggtttgatgctggagcgcaaggaggggctgcccacatgggcggagcagagggcctggggaagttccaggaagaagtgactgtgtgccgaggctgcaggagtagaggcagcccaggagaaaggggggcatgggctggaggtgggggtggttccaggcagagagagcagcttgcacacgggaaaacaaggcatggagtgggcagctccttccgcctggtctctaaacctgtgaagagggggctggggagaagagacgggggtggaggagagcaggactcacaggccagccagccctccacagccttgggaacagagtgaagagcttggactgtgtcctatgtcctggggccggtgccactgcaggctttggagccaggagggactcagtggagcttgctgtgtatgattgtgagtgtggggaatggtttggggtgggaggcaggacaagcagctgtggactcctgtctgcaggtgagtgccagggctcagtgtgggttctgattgggctaagtaggtgcccatctgcctggagtccagctgtccttgtgtggtctgtagaccttgttgtcaaggtctggcagctcaacgctggtctttctgagataatgaaaagggaaaactttagaggcaggacgaagaccttgtagtgaccagtgacatccccacagggtctaggtgtgcgaggtctattggcgcctgtgtgggaaggcgggaaaccaggggcttggggccagctacaaatgccacactgggctctgccttggctctaggtgctttggttgctggatttggtggtggctcagggcagtcacttgtcattctcagtattttatcccctggggcctcctcagagccataggagatggttcacctctgaaggactgccccatgctgtgcttggtaagctcggtcacccagggctgtcacagagatgggctatggcccacatgggctgagcggatttctgccctgccacctacaccttgctgtgattactttggcagtgtttccccgtcaggagagcaggtgggaagggaggcaggtccctgaactgggatagagcccggagacctgggtgtcctctgctctgttgtactgacacgctgcgtgcttatgaaatgagggcaggggttctcagtgctcccatggcatggtgactataatccatgaatgatgcccacacagttcctggcatgctcagtgtagccttgttgttgtaagagaaaaaagcagggattctccacttccccacagagtgaactggaacgaggagagactggtatttctccaacactaggtttctttggatttttatgctggttgatactccctaaatcacaggtcgccttaaagagagcaagagccctgcacggtggcccggacccttggggccccttccatccgatgcacctcgtggcccagtctttacctgctcaccatgcacagcacttcgcatgggtttggaaacgtgtcatctgcatggcaaggatgggaatggggagtgggaacctgcagtttagggtccaggcgggtggattttaatttgcccctgggggattctagggccagcagagctcactgccgctgctgtctgggcctccaggcagtgagctgctgggggagcccctctggaaatggacagtggctgtcagggcgtaggacgctagggggcgaacagaggaagtagaggtatctggggctgaagttcaaggttgcagcatgaagttcagggttgcagcgcccagcctagcagggcagggttcaatctgcaggactggcatgaggaggcagaggagtcagccaagccctcccctcagcctctctccagacactacagatccaaggccaggtctgcatgaggacagccacctggtctcggctgaggttacaggaagggagtcggggcaagggccagtgagtttgttcctaatttgggtcccctaattgtccaagagaagaagaaaaggcctaatttctgtttcgctaagttttagactactttagttcatgttctttaacaataggttattcatgcagagctcatctctattaatcaaaatgtatgattaggcagaaagccctattcccacaccagagtggtgaaatgcagtgcatgtgtgttcagatcaatttttgaagtcttgattttgttttgttacatgtttatttgattgcttgcagaagaatgaagttttttggccctctggaaaatttttctttctcctgagaggttttccaatctagtagaaaatagacgcagagtttggcttgcactgattgcggcattagaagcggccctgtacattttaatgtggaagacgtgatggttttgcgtttgctcctccagttgtgccccatagctgtctttctgccagctctcttgcacatttagttcttgagtgagatgttctaaatagaagccatggtccattcagtccccagcctgctgtccttctgtgacccgccagccagctttgcttagggagctatgagcccctcctactaggctacaaagtcatgggcaggaaaagcatttgtgcacagccaggagcagagcacccaggcccaggtctgtcccggagccatgtggacctggcgaatggctgttcaggtcagaagggggtttggatacaccggttctgtgtttcggaggccagcgtagtccccagtgtatttcgcagaagtgatagcagctttattcccaaggcactagtgcctgcgcgttaggcacgtgctgggtgcctgcttgagtgtctcctttgttcctctctatcactggctgtcccctgcagaggcaagcgaggcagagagttggctggtaacagccagtgtccgcagagccccagggctccctgactgggctgtgccacctggggacaggcagatagaccccaagtaaagttaaagggaagcacagtggggcctgcacaggatgtgagttggaggctctggtgaaactgagacttggtgggggatgggaggcaggggccctgctgggacagacaggagaccaggggccagtggcagaaatggtcctcgatctaccctcatgcagatggtggcctctaccgggagccctgtgtgtctctgagccttagtctccctccctccagtctgcgaaatgggcataatagaaatgatgcctctcactaataaatctgtgcagaaagagaaagcagtttgcaactgcaaagcattattcaggtcttcctggctctacctccaggatcgtatgcctccgctctctcacgagacacaggcctcccatgtgcccggtggtggtctcgaggtcatctgagccatcatccacccctctataccggggacagtgtgctgccaggaggggcaccagaagaggtgtcatacagtggcatgctgagctaggatttgaggcacttcctgcctcttctagttccttgtgggccgggggtgctttgctcagatggtgctggggaggaagggcaatatctaaggatgtattgagagggtcacattcaggtgtgccatcttctgagggacagaaccctgtcacgacagttttgccgtgactgaattcccacattgcagagtgcgcttggggtgtggctctgaacatcgctggcaggtcaggtggagcctcgctgctctggggagctgtgcccaggttccctcggttcctgaagctcagaggttgcaggagaaagggcctcctggtggctgcttactctgccccactgtgaagtgcctggtcactagagttaggcctctctcccactccgggcttcagggattccactgaggatggagggtgttggatttagtttcttttttttttcttttttttcttttgagatggagtctcactctgtcgcccaggctggagtgcagtggcaccatctctgcttactgcaagctccgcctcctgggttcacgccattctcctgcctcagcctcccgagtagctgggactacaggcgcccgccaccacgcccggctaattgttttgtatttttggtagagacggggtttgaccgtgttagccaggatggtctcgatctcctgacctcgtgatccgcccacctcggcctcccaaagtgctgggattacaggcatgagccaccgcgcctggcccccttctggagtatttcgttcattagaagtaagtcagggacttagtgtctttagctccagccagtcctgtggcctctctgccactgtgtgaatgtccccaaccccccacctgataagcaggtgtcctgaggtcatcagggatttggacttagttattaaaaagcaaccagcacccttaggagcctccagagcagagattgccaaactttctcagaccacggtgccctggatctcagcaatttcatggtgtttctagaccaaaacacatagctaacaactctactctttaagtagctaggtccaaaccacatggtatttatgtcccaacaacttggaagccacatgagaaataatactcataaattgaaacaaatgtatttcatcctaaaccacaattacaaacggaagtgtgtctgctgaatgagattggcaccattctcatttcctgtttgatgctgacttttgtgtgggacttgctgtttaaaagtttatttttatttttaatttttatacacatatcatagttatacatattatgggggtacgtgtgatattttttcttgagacagcgtgacagagttttgctctgtagcccaggctggagtgcaggggtgcaatcttggctcactgcaccctccacctccctgttcaagcgattttcatgtctctgcctcttaagtagctgggactacaagaggtacgccacctcgcctggctaatttttgtatttttagtagagatggggtttcaccacattgtccaggctggtctcaaactcctggcctcaagtgatctgcctgcctaggcctcccaaagtgctggaatcacaggcatgagccaccgcacctggcctacatgtggtattttaatataagcatatacattattaattgtggcaaagtacacataacataaaataccatcttaatcattttaagtgtatagttcggtggaattaagtacatcaacattgttttgcagtcatcaccatcagctatctccaaaacgttttcatcttcccaaaacttaaattgtgcgcatgaaacagtacctctcctttcccccttcctccagcccctcccagccaccactctactttccctctgtctgaattcacctctctaggtacctcatgtaagtggaatcgtgcagtatttgttcttttgtgactgtcttatttcacttcgcatggtgtccgtaggggtcctgcacgttgtggcatgcgtcagaattgcttccttttttagtgctgaataacactccattgcgggaatatgccacattttgttgatctgttcttctgctgctggacacgtgggttggttccgccatttggattgtggataatgctgctgtgaacaggggtgtacagatgtctccctgagtcccttctttcagttcttttgggatatacccagaagtggaattactggaccatatggtagctctttttaaaattttttgaagtgccatactattttccacagcagctgcacccatttacatttctattatgccaacagtgtacaagggctccaatttctccacatcctcaccagcacttgtgttttcattttttttgtttttcttttctttcttcttccttttttaaatggtactatcccaacaagcgtgatagcaggaatttgcttttaattacagctacttctggcctcacgagacgtctttcagaggaatgtagtgtgatctcaccttggaaacgagagctgcctcaaggcagtggtgcatgcggtgctgacaggtgccaagggtcactgccttccccatggacatctgggctgtgctgcagtgcccctgtgggtgcagcagggcccctagggtgcctccgtgcagcttgggagccatggaactagacagtgtgcttcagacgagtagataagcacagaaacagagccgtaaggactggggggaacgtccagtccatagttctgtgtggaaccacgatccacggaggcagctgaggggcaagtgtagtgtacgtggctgtgcgctccatctccgtgcttacagccctacaaagtgggaagagaatggaagaaacaggagagaaaaagtcccgtgtggtttcccggaatcctgtgggtagtgagagtctcagcattgttattcctagcatgttttgtgtgtaacgtgagatgaagcaaatgattactgatgtgatcttttaactctgaggaccttgaccaggattttcagtggcgaggagaaaggagatacggaggaaaggtgctgcgggttaagaaagcctcgggaggctgggcgtggtggctcacgcctgtaatcccagcactttgggaggccgaggcaggtggatcatgaggtcaggagatcgagaccatcctggctaacacagtgaaaccccgtctctactaaaaatacaaaaaaaaaaaaaaaaaaaaaaaaaaaaaaatagcggggcgtggtggcaggcacctgtagtcccagctactccgaaggctgagacaggagaatggagaatggcgtgaacccgggtgaacccgggaggtggagcttgcagtgagccgagatcacgccactgcactccagcctgggtgacagagcgagactctgtatcaaaaaaaaagaaaaaaaaaaaagaaaagaaaaagaaaaacaaagcctctggaatccggaactacaaatccataagtagccctagagcgttccctggagaggcctggaatcagtggccaaaccaatcacacggagcacccccagtcccgggtcatgtcttgaaattcagttttctgctgaaagaagctgagactacttggacaaatggttgataccgggttgggggcgggaaatgtacaagttgaacctaaatgctttgtcatagcagataataaaggagccaccctggactgtgaggatgtgattctgctgagagagagcattaaaagaggaaaaaaactattaaagtcaaagtccacgaggatagtgttaaaaggactcgtgagctcacctgatgaggccagagatggacaatttgaacatcagtaagagtaaaaatcacagtaggttgaaatgtatgcagtatgtttaagtccatgagtttttttaacaatactcaggaaataaacctaatccgtcacctttggagaatgctagggaaccaattatatatttttggtaaataagggaaagctctgaaatatatatcctgcttttcttatgcaggccgcactactgggtgagcaggtggcaggttgggaggttccatgtatagaggatggaacctctgtgtctgaagcgtctcagcacatctgaattcacaagctgggcgctggtggccctggggcctgctgacatctcaggaagggaggaagagccacactgcccgggagctggtctgcccctattctaacagggatctcattcgacttccagatccaaccactgatttgcaggaacggaaaggacagaggacgatgtttggctgtgcttcaggcacctggccatcaaaagccaaaccatgggaaatgctgtgtgaccaacgactcttcagttaataacttgggaggcaaaaaaaaaaaaaaaaaaaaaaagaggtggaagcacaaccaacggttaaaggggacataaaaggcacacatagtgtgtgtgtagggacatgtgctacatggagcagggtggggctatgattaccctacaaccaggatgtggtcaggggcacacagggaggctgggtcccgagggctggagtggccggtagggcccctcttcttccctgcctgaggattgtaaaggttgtttcatagccgttttgtttgtttatttatttatttatttatttagagatggagtctcgctctttcgcccaggctggagcgcagtggcgcgatctcagctcaccgcaagctccgcctcccgggttcacaccattctcctgcctcagcctcccgagtagctgggactacaggtgcccgccaccacgcctggctaattttgttttgtatttttagtagagacacggtttgaccgtgttagccaggatggtctcgatctcctgatctcgtgatccgcccgcctcagcctcctaaagtgctgggattacaggcgtgagccactgcgcctggcctcatagccatttattaagctaaatatttacactatgttttctaaaaaagtaaaattattttaacaacataaaagtcaaaggaagaagttcctggaagtggtcttgaaggtgcaagtgggcaattgtgaacagtctgctggtgcaggatgtggcgcttcgtcgtgggagtgctgtctccctccactgtgggccgcgctccttcctgcagcactcgcagctcactgctgccatttcccgtgtaatcctgtcttctgtcttgactcagacccactcgtatctttgttgtctggggtctgcgctttactaggggaccttggagttctgttgttggctgtgacttcattccatgttctttcccataaggaactgtgttgggaatagtttgatgattccatggtcatgccttttggccttttctgtgaggggcgaatggggagcacatggaacttattgctgctgtcttcagtatttcttgggggaggaactcggtgtggttttttccagcctgagcccaccctgaggtcggttgttggacccacctgcctgatgcagactgccagggtcttcctgccagcgcgggatcccccactttccatttcctcttgcaaccatcagacccagggacacatgtgtggctccttctccagtaagcgacctgggaggtatccttaccccaggacccgagtgagcgtctgttggagactcccaggtgtgcaggccagaaggacatgcccagttgtgtggctgcctcttccctgcagggagagagagaaggctggcgtggggcttctccccgggctgggcctgcgttgtccccgaggcccgtggccgctggagcagcccctgagcgactctgctccttcctgggcctcggtttcctcgttctcagggggggcttctgccagactgtctgggagatgttttcagccctctaatttgtgcatgctgtgactcacccaaaattacagagcaaagctaatggaatcaggaatttataaatcccccttccttcctcacgcggttccttgagtttttgaaaactaccattcagaatgagacagtggccttctacctgaggccacagggttgtctgtggcctaactgatttctggccagtcaggctgggtgagcctcaacagcgtgaacatactaaaggcttcttccttgccctgggacaccggttctggccaggctacagggctcacagctcagacctgcctctgcctgggagtgacacggtcccctctgctcacgtgccatggatcagagctgccatgtggcccagcttagggagaccaagaagcatgggagactccccggctatttgacgagcaggacctgtccatgccatctcccatctgtgccctgcatctgcgacttccaaagagcattggcctgcactgtcctatgaaatgctaccacaagccctttctggcaagtgcagttaatcctgttcggtgggttaggaaaccaaggctctgagggaggctttcagtgccacagctgggaggtgagagttgtgagttgcagatgtctcagccatcccgagcgtgaccattctgagtggcgggaagcttttcactcagcactgagtacatgatgcctacagtgttctgggcctcctccatcaggaatcatgggcccttctccccaggacgctcatcgatggccccggctcctccagccctggctcctccagccctggctcctccagccctggcccctccttgggctgtggctgcaccctgggctccacccattccagacccaaaggcccatgggccaaccagacaccgcccctacatggtgtgcccacaggctcttatggatcccagagggccccctttgtcctgcttggggaggctggggtggccgctacacagtgccctgccgtggcccccatgctccccaactccctactgtgtctgctggacgtttgaacagcctcctgccctaaaccttgcatcctgccacctctggcccactctccaccctggcctactcttcaccctggcccactctccactctgcagccaagtgatcttttccagcagcacatgtgactgagtattgctgatggctgcgactgctttcaggatcaaattgtgtctcttccgaaagagacatcagataagagacattggaaaagaacatgaattgcggtcacccagagctctttcgcggtttgggattaagccatgcagaaaggtgtgcaggagcctagatcacctgccaacctgcctcttgccatcctctattttgtacgctcagtcaccccagaaaattgctccggcccttggatttacctccgtgtcactgtccatccggtaccctctgcctgggatgcctcctgggtctccatcacccgcctcactcgtttttcctctgcacatggcatctacttccgcccttccgcaggacaccttcccaggctgggtctggaccaccctgcggactcgctcctcgcaatactggccacatgccctcaagcccatctgtttcttagagtcgatgtcccctaaggtgtgagttcctggtgagcaggagaacctgtgccttttataacctggtgtgctgctcggcgtgccgaaggaaccaaggcgatgttgagaaatgaatggaacagctgtactgtgcagagatacgtgcagagaggggcaggaggaagcctccacttcagacttcagtgtgaaaaagagacactggaaaagaacatgaaatgtggttgcccgatgctcctttgtggtttgggatgaagccctgcagaaaggtccgggcagcactgcagccccgccatgctgcttgccccacgtgggttctggagtctggtggcacctggaagagcaggtggagtggaagctgctagaaggtgggaacctgagggtcctgggctggcagaggccttgcccccgctttgcctagggaggcagtgagcttcctccttcatttgaactttgccctgaagagctgggccttccttgttcatggggagcctgatgcttcttcccagcacaccacagccacacaggaggtgcagcagagcatgcggagatccacctggcaactcacagccagccgcggcgtcactgtcaggactctgtgaaaaacaaggtttctgtttggcgcggggacgaccagagggaaggagactggtagagcctaagtattcagccgaccattaaaaagtgaaagtcagaagcaatgtaagtcaaaactcaggacatctcagggtgaccttggccactcacagttgttcgtgtttgaaatcacattgattctcgcagctgtccaaggcgcaggaaataaccactctgggtgatgtcgttgggatggttttgtcagcactcaggatttgggggtttgttatgaaaatttcacgttacaaaaaagggagaagtgcagttttgtgtgtttagggttattggtggctagacatctgaaaatcaggatccccgctcattgattttttttttttttttgagatggagtcttgctctgttgcccaggctagagtgcagtggccaatcttggttcactgcaacctcggcctcccaagttcaagcgattctcctgcctcagcctcctgagtaactgggattacaggcgcctgccccccgcctggctaatttttgtatttttagtagagacagggttttaacatgttagccaggctggtaactcctgacctcaggtgatcagcctacctcggcctcccaaagtgctgggattacaggcggtgccgctccttacattttgttgctgttcccaggaagattgatggagggaaaacacactctccacagaggagatcctgtgtttacagccgtcttagatagagtcgtgatgaggaggaggactctgggccgacagtgtatgagggttccgcctcataaggctgtttggtgtttgtgcccacactgggtgtgacgggttgaagcagtggataacaagcctattactgttatgcaaatgtgggcggcccagttgcattcttcatgcatgtgtctctccctaatgagtttcaaaatcttaatttagatcttgattttgttgcagataggattccaatttaaagagcgtttgtcattcagagactgtggtagacaggaaaatggtcttcagagatatccacaccctagctgtggcgcctgtaaatctgttactttatgtgacagaaaggactttgcagatctgattaagttatggatcttgagatggagagattattctggattattcaggtgggcccttataatcatggtgacccttataagaaggaagctggaggagttaattgtcagaggagaaggtgctgtgacgatggaagtggagattgaagtgatgcactttgaagatggaggaagcggctgcaagccaaggaatgcaggtggcttctagaagccagaaaaggcaaggaaacagattcttgcctagagcctccgtaaagaaccaggccagtcgacaccatgaccttagcccaaggagacctgcgtgggattcctttctttttattttctttcttttcttttcttttttttgagacaggatcttgctctgtcatccaggctggagtgcagtggcgccatctcagctcactgcaacctccacctcttaggttcaagccattttcgtgcctcaaccacccatgtagctgggatacaggcacatgccaccatgtctggctaatttttgcatttttttgtaaagataaggtcttgctatattgcctaggctgttcttgaactcctgggctcaagggatccacctgcctcagcctcgccaagtgctgggattataggcgtgagccactgcactcagccctctgtgggatttctgaactatagaactgtaagagagcaagttggtgttgtctgaagtcactagatttatggtgacttgtcacagcagccataggaagctaacacagagactcagggaccaagcctttccattgcagcaagattgatcagttgttctctcccatcacggggctctcattttgctcaagtcctatgtcatcgtccctcttttcctggagagcaggagctgacttcagacgccagatcttcttttcctgccacagcgcacttgcagctcttgggaggtgaaggttctgcctgctgctcttctggaatgataaacgctgggcccttagtggaaatgtcaggtgaaatggaaggcagctccttgggtgcagtgacaggacctgcagtgggcctgttggagctggcactgagggctgctccccatccctctgtgggtgtattggctgcatgctgactggccgtcctcgtgggcgtggcctggtgtgtgtgcaggtggacagaggctggagtatccttgagaggctgtgcgttctctcggcttcttttggagccagagccatcagggagccatcacctgtcctggcctgacctgtcctgtcatgagtgctgtgttccttgagctgcctctcaggctaggggatgaggtggctgtgctcaggcctggcttctgcaggcttcttcctatctttggagcggctccaccactggaatctgtgacatgagaggcccgtagcccaggcccatcatctagaatggagaggcagccccacagcctcctgggaaccagagctccttgcctgggtcatcacagaactaagccttaaaatcaggaggcctcagcaaagcgcctctagagactcaaaccaccttgtaaatctcactgggagtgaacgattgactttttactcagtaccaggactacatactacctcatttatgggtttttcctctaaattgctaatgtttgaagtggaaattttcaaaactgactaatgtctctgcttcaagatttgctgtcaggcaacttatttataaataaagcagcttttcaaggagcactaacaaacaatccctcgtgttaggagactcagagccaagtcgtggctctaggttggccttgcagggtgttagggagccagttctccaccccagggccatggacttctgggtccttgcaccatccagagaggtgatgatgtggttattcccatgtatagagtctactgttttcagggggcatttgcatctgtggtttcattagatgttcagagcatccccacaggggttagttcatgtagagaaggaatcagaggctcacagaggttcagggtttgctgggtcaccagctcctaagaggggccctttgggctgaggccacggcgctttctttcttgcaagacagaaattttccttttcctttctttgccataatggccacctccttccaccccatatccttcttccctttggccactggtgagttctgattatttttggaaaaaaaaaaaaattaaaactctgggagcttgagactgaggtaaagtcccctttcgtagagatttttggactgacatgttagctctctgccctgtgtaacttcagagtttggtaggtgatggggacacgcctgttggagagtcctggtgtgtccagttttgtccccgcagcttcactggctgtcagagccacagcctttgcttacggctacgccctggaatatttaacagcaatttcttttcgctttcttctgtcgtgttctgtctgtgtcagtgttttgtggtcttactgtacctgttgttttattataggcagatactgtaaacgctgatacagtctgtgccctgcggttgtggtttttagggccttgcggcggcatctttgctagtgctcactgcaaataggggcaggaagcagttgtttgggaatgagccacatggtggaatatcttgaatgtcccaggccaggcacagagcagctgctcagtaaatgttgctgagtgagaggctggggggttggtgaggataggcaggggtgggcgtccaaggctgcagagttgtaaagcggggggtggggcagccagcaagtccagctcgaggaaacaccacggggttcaggggctctgtgtaagaaatggcagaggtttggcttcgcttttagttgttttgtttcttgttcaagtgaggagaacacaccgagaagggaggagagcaaggctggctgagcgtcatggcagggtggtaaaggaatcaatcacccggacaggttgtccgttcatgtgccgttgtttgcattgctgtgatacagactgctgtgccactgaaaccttccgaaaagcaagccacccagagagtgacttgggcaggtgtgtattcatgtgtgcatcagggagaggaatacttgcaaggagcagagcttccagaagaccaagattcagtggaggcagcaagtcagggccgggcagaagcccctggggtatctgcggaagagcactttccagggtgcatggatggatgcgttaaccagccagttcctacgcatcacggaggagaggtgcctgccctcctgggagccgtgcctattccattgcttctgttgtttttttgagacagggtctcactctgtcacccaggctggagtgcagtggcacgatttcagctcactgcagcctctgcctcccaggctcaagcgatcctcccacctcagcctcccaattagatgggacttcaggtgagcaccaccatgcctggctaatttttaaatgttttgtagaaacggggtctcactgtattgcccagactgttctcgaactcctgggctcaagtgatcctcatgcctccacctcccaaagtgctgggatttcaggcgtgagttaccacacccggcctcttgttgttgttagtaaacttttaattctagaacagctttaaagttataaaaaagttgcaaagactgcagagaattcccatgcttgcttcctccagtcttctctctcgttaacatcttacatcacacggtgcatttggcataactgaggaaccaacgtgggtccattgctatgaactaaactctgcagtttattccaatttccttagtttttgcttaatgttttttttctgtcccaggagcctgtccaggccactacgttacctatagtccttgcgtctccttagcctcctctggtctgtgacagtttttcagctttccttgtttttaatgaccttgatagttttcaagagtacaggtctttgtgaatatccttcgatttgggtttatctgctgttcttctcatggttagactggagttatgggtttgggggaggaaaaccacagaagcgaagcaccattttcaacatacatcaatgttgcatgatatcaatatgactcataactatcgatgttgaccccgatcagctggctgaggtagcatgtgccagttgctcactgtaagattaccccaccttcagcggggtgcggtggctcatgcctgtaatcccagcactttgggaggccgagtgggtggatcatgaggtcaggagatcgagaccatcttggctaacatggtgaaaccccgtctctattaaaaatacaaaaaattagccaggcgtggtggtgggcacctgtagtcccagctacttgggagactgaggcaggagaatggcgtgaacccaggaggcagagcttgcagtgagctgagatcacgccactgcactccaccctaggcgacagagtgagattctgtctcaaaaaaaaaaaaagaaagcaaaaaaagattaccccaccttctttccatagtcctccctggaaggaggtcgatgtgcagagcccatgcttaaggaatgtggagttacactccactccttcatggggggtggggatatctgtataaattatttggaatatttctgtatgggggacttatctattctcccccatttatttattcaaacatttacatcaatatggatttgtggatatataatttataccttgctttataatccagtgctgtgttatttattttattgctcaaactgtcccagctttgactatatgaagctctttcaggtggcatcccatgtcccttagagagatccctacctttttgtttttttgagtacagtcagttggccatatccgtgagttctgcatctgtggattcaaccaaccttagatgggaaatatctgggagaaaaatagatggttgcatctctactgaacagactttttgtcttgtcatcattccttaaacaatacagtataacaacgatttatatagcatttacattgtactaggtattataaataatctagaaaggatttaaaatatattgaagaatgtgcataggttatatgcagattctacaccattttatagaagggacttgagcattgaggattatggtatctacaggggggcctagataaccaatcccttacagatacccaaagaaaactgtacctctttctggcacaagatactcaggctcatcttgaatttttcctacccagtcctggactcagctatttctgcaaggatccctgccttattttattgaagaatggtatctagaaaccaaggtctggagacagggttcttcttgtcaccgaggtacattgcttccaggccctctcagcagacagagctaggaaatatgcatgtatgctaatctgtgtatacatatgtatctcccatagtttttttttatttttttattttttgagacaaagccttgctctgttgccaggctggagtgcagtggcacgatctccactcactgcaacctccgcctcccaaattcaagcaactttcccgcctcagcctccctagtagctgggactacaggcgtgtgccaccacacccagctaatttttgtacttttagtagacagagtttcaccatgttggccaggatggtcttgatctcttgacctcatgatccatccgccttggcctcccaaagtgctgggattacaggcgtgagcccactgcactcagccttttttttttttttttttttttttttaagacagagtctccctctgttgctcaagctggagtgaatggcacaatcttgtctcactgtaatctccacctcatgggttcaagggattctcttgcctcagcctcctgagtagctgggattataggcatgcaccaccacgcctggctaatttttgtgtcccatagcttttttttgaatgcacgaccccatctggcggcgaagccctggacctagccttctgatcactcatgggaaccatgaccacgtgtcacatagtagaaaggaaaacttggacaacttactgtgtagacaggagcagcaacaacaaaaaagacttggaaggcttaaagaatattttccaagtatacacaaatacagagaataataagaggaatgactttgagagcctgaggcaggaggattgcttgagcccaggagttcaagaacagtctgggtagcatagagtgaccttgtctctacaaaaaaattaaaaaaaaaagccaggtgtggtgacgcgcaccagtggtcccacctccgtgggaggcagaggcaagaggatcacttgagcctgggaagttgaggctgcagtgagccatgattataccactgcattccatcctggctaacagaccaagactctgtttaagaaaaaaggagtatctggggtacctgctatccagtttaagacatgtacaaatatgattcagccttccatgagcatgcctccccagccacccctgtgaaacccagtaaattgaatttactgtttgttttttggaggcatgttttatttttacactgcatgtatgcctaaatgatatatcccattgttatgatattttcaaactttgtagaaatgataccttactgtgttcctacaacttgaattttcattaactgagacattttacatgtatttatcttcttagcaatcctgagaaaagcaagagtcactatctccattgtatagatagagaaactgataatgtagagcaatgatgtgatttttgctaatttcaagcagctaatggagatcgactcacatttgtaccttcagagccctagtccatgctctttgtatgacataaatgtcaagattcatcaggaaaaggaagaacaggcgggtcttgttggttactctgtgaccctgttgcttccctgggacctggaagtcctggtgtctcccttagcctggaatcccagtctccatctgggttttgcaggctccaggagttttgatgaaatgaggacccatatggctggttgagactcccaccccctcatcactccctaccagcgtttgtgcagaatcctcctctcctcccgagttggaaataatgtatagttggctcaaaagtcagcccctccttattttagcaccagatgctgcctctcagcttcacgctgccctccagcagcattgcctgtggtccatgggatcttggccttcacactcagcattgaaacagctgccttccgctcccatcataggaaagagaacagaagtctcttgctcccactccccccgccccaccccctgctgctggcctatttctgtgctttgttttgctgtagaacttctggaaagagttgtctgcagtggctttctccatttcctcccttcccgttctctcttatacccgctccagtcggacttttgccccttccacagacacctctcctgacacttttgaccccatcacttagagatcaagatctgtaagactccaagtctccagatccagtggtcagctctcggtcccttcccatgtgactgaccagcagtgtttgccacagtcgtcccctctaggaaacaccttcttcccttggcttgtggggcactctgtgcttgggattttcttcctgcttcactggactttgctcagtccccttactgacccgtgagtgtcagagtgtccctgcggtcagtccatgcccctcttctccgctcggtccacactcccaccatggttgacctcattccgacttgtggcacaaggagctcacatttatcttttagctctgatttctcttctgacctccagactgtacaccctgttgctcacccagcgctttcccttagagttctaattgacgtccccacacaacaggcaccaagctgtccctggccatctcaaccccaatctccacatctcagtaaatggcagctccatgcttccggacacctagaccatagacttggagccaaccttgactcctgtctctcttaaaccccacatggaatctgttccgtaagctgcccatggtcacaccggcaccgctgccgtgcgatgagagcctgtcatctccttgctagattgctgtgccagtttcctgatggttcctgtttccacactgactgcataccttcccacccaagtctgtgtctgctcagcagctggtttattgcatacaaacttaaatgagaatgctcctccgaccagagctctccgttccctggccatcccattaagagtaaatgctggaagcccctcctcaactgactttatttcttaaaactctatcctgcaaaatcctgcctggctaataactttatcaccttcttcgtgttggttccaacgttcccttctgcaggtggcttctgcggactttggtactggcccacatccctgagctggtaaccccccaccatgcacaggcacccccacattaattctgtagcttatttgtttattgttgtctgtgccactccagacaggaagcctgtgggggttgggggcttggtctgccttcttcagccctgggctcacagtcctgacatcttcttgaagacggcgctcacggtcaggctgcagcaaattcacagttgacatctaggagtgagggcctcctgccatgctgcactctggcctctcacctgcctcctgctagtcctgggcacacctggaggacaatcagggaatttctttccccatctgctttggcatcctccaaacctgggaacctttctaacacctgactgcttggtgaccatgtgtgtgctctgtggatttctgtccaggagggtccctcactctggccctcagggccatgtgcatgtggacaccgactggtagggttggtttcctatgcagagagcagggccagaggcatagccggcccacccccagccccattgctcacggttcacccagtcccctggcctttccgacgctgtgcgcatctgtatttgttgcagtgaacagagcctagaattataggactttgtcagacagtttgattttcaaccccgtaaaaaatacattttacttaaccacctaggatacctctacattatagacctcaagcagaagtttcaggagacagtttcttactctcattagaggtgatgcgttttgtgtggtcttcggtttcattgccccataaactcacttggcgatctgcctgtgggtccccagcagtctgtaagccacagctttctcaaccgtacttcctgttctggaggagaaacctgagctgcaaagagctaagggtcttgctaaggtcataccagtgaattcaccaaacagccagtactggaaccctgtcctctgattcccatcctgtggcttttttaggcttgtgtaatcaattttaatgattgtaccattgtagcttatttaaattaccccaggaggaacatcagctctgttcaagaaatgttattgtagttgctcacctgctttgttcagggaaatgcatcttttgtgggatttcttctgagtaattaagagggtctaagaagccagttttatagtcatttatttaactgtagagaacaatgaagttaaacacaaaagctggttccatctgcaggaacatatgagtgatttgcattagaaagggtgttcatcaaagctcctcccaggtgcctagggaggcatggggggccttggtgggttccctgagggtcgggccaaggccttgggccagggagcacagttccattgcactgggtgtgttggggcagaaccttgtgcttggaggtaggtgttgcttctggccctcggttgcttgctcctgcaggcagggccgtggacccgtagctcagcaaccatggaggagctgtgagaaatgcacagtctcaggccccaccctggctctgctgacttggaacctgcatgttaacgagactgggggtttgtatgcacatcacatccggtccagctctggcctgaggactccggtctgtggtttctagtttttatcatccagctggtcatcctcagcagtagagaatgtggttggttaccatgtgcagggcagcctgctatgtgctgtggtaacagaagggtggggcagagccctcctagccctcccagccctctggggcttgctgtctctagggcaggcaggggctggcatatgcagttgtacaccatggtgttttacaaagcacgagtgccatggaccccatgggtgggctggattgagatgcaaggagggaaaacagatggggtggggtcccaagcaggaggaactgcatgaggaaaggcgtggaggctggacagatgcagaggcagtcagggaatagccagtgtcagaatggagcaggcgacagccgggttttggaggctttcagtcccacgtttagatatttggactttatccagtgggtcatggaagctactataaactttttaaaattaaatactattttatttaaaaaattgtgtaaaatacacataacataggattcaccttctggaaccatgtttaagtgtagagctcagtcgcattaagtacatttacacggttgtgcaaccatcaccccatccacctccagagctctcctcaccctgcaaaactgaaactctgtccccattaaacacttaactcccattcctcctcccctcaccccctggcacccaccattgtactttctgtctatgattttgacgacttcaggtgcctcgtatgagagcaattgtataggatttatattttgtgactggcatatttcactctcaacgtcctcacggtgcacacacgtcgtagtgtagcacgtgtcacagtctccttgtctgttaaggtcgaggaatacttccttgtatgaatagaccacattttgttgatcgttcatctggtgaaggatgcttgggttgcttttacctcttggctgttgtgaatcatgctgctgtgaacatgggggtacaatctctttgagctcttgttttctttttctttttttttctttttcttttgagatggagtctcgttctgtcacccaggctggagtgcagtggtgcaatctcagctcactgcaagctccgcctcccgggttcacgccattctcctgcctcagcctcccgagtagctgggactacaggcgcccgccaccgtgcctggctaatttttttaagtatttttagtagagacggggtttcactgtgttagccacgatggtctcaatctcctgacctcgtgatccgcccgcctcggcctcccaaagtgctgggattgattacaggcgtgagctactgcgcccggcctgagctcttgttttcacttccttcgggcatacccccagaagtggagtcattcctagatcatatggtgattctatttttaatgttttaaggatagcattttccaaaggggctgcacaccattttacattcctacccaccgtgtacaagggttccagttttctccacatcctcaccaacacttgttattttctggtttttcaatcgtggccaccctgatgggagtggggtagcagctctctgtggtttggatggcgttttcctgatgcacgatggtgtggagcacctctcctgtgtgggagcactgtggcctggtgagcaggggctctgtggtggggaggcgcgtgccgagggctgtaggagagggcgacgggtggtgctgtgcatcaggttcggggtgatgggaacgctgtctcttgcacctgcacatcaggcctcccccatgctactttggtggcttctgtgggagcacaatatgtccagggtgccatccccaaggcagaagggagcaccatctggtttgatgtgtggcctgtacttcaccaagcccaccacatttggcctatgactgtgtcctgctgcgactgggttgaagtcagaggagccgagacaggcgggggagcatttggaggacgtgtcccttgctgtggtgtctttgcagaagtggccagcacttgcactgcccagtagtattttcgatgctcctgggaacatgagaggattgcactctctgctttctcaaagttagataagaccatgtgccttgcttcagccaatgacatgtaagcagaagtgacttgtgggtagaagctggaagggactttctatgctgtcctttctccagtcacatcggtcctagaagcacatgcctaggaggaggggccataatagcaacgtggctgttatttgctttggactcacagtggactttgagtgagcaagacagaaaccattactgggcccaggccctgtggcgtgggagctgtttgttgtcacagcacagcctagcctgtcctcactgatccaggaggaacctgaaaagtattttaagtgcacagataggtgaagatgaaagtgtagcgttttgggataattctgcatgcttcttagtatctccagcagtttcgagatttggcgaaggggctgaacttttctgtaggtaaatctcttgctgaagagttcattatcagctggtaatggcttcattttgtcagcggcacagagctctggcttgtgcgtgtctgaggcctgtccccactggggcagggaggtaatgagaactcatgaaccctgcatctctgcctggctttaacagcctctgtgttttccagtgcttatcaaatccagagctgtttacatttcaggagacaacttcagactctgtggacctcattatacttccaaagcaggagggtcgttgtttttaagcattattcccaacttttttttttttgactgcagaaatgcctttttaatatcagaaaatttccaagttttccttacttggctatagtcttgtttttagtactgctttggtggttcagtaactattcattaaacaaatctcttcattttaagtttatttcttctatagggctcttctcttctcttctgttctcttctcttctttttgatacagaatctccctctgtcgccaggctggagtgcagtggtgcgaccttggttcactgcaacctccacctcctgggttaaagctattctcctgcctcagtctcccgagtagctgggactgcaggtgcatgccgccatgcccagctaatttttgtatttttagtggagacggggtttcaccatgttggccaggacggtcttgatctcttgacctcatgatccacctgcctcggcctcccaaagtgctgggattacaggcatgagcctccgcattcaaatatatgtaaaaacggagagaattgtgatccctgaaaattcatgtgttgaaatcttcacccccaggacctcagaatgtgactgtatttggagagagggtctttgaagaggtaactgagttaaaatgatatcatcaaggtagcttaatccaatctgactgatgttcttgtaagaagagattcagacacagacaggcacagacggatggccgtgtacatacatggcggaagacagccgtatgtgagccaaggagcgaggcctcctgagaaaccagccctgctgacaccataatctcgacttccagtcgccagaactggaagaaaatacatttctgttggttaagtcccctagcctgtggtactttgtgatagcattcctagaaaactaatacagtgcctgtgtgctattgttcagtgtcagcagttccagtttttaagcaatcttcatggactgctcccgaagttcagggagcatggggcctatagcagagaactaggcagcacctgcccttgtgaaactgacactctacggaaactggaaaaattcatgaggacaagcttcagttaacaacactttgaggctgggtgtgggagcttgagcctgtaatcccagcacttcgggaggccgaggcaggtggatcacttgaacccaggaatttgagagcagcctgggcaacatggtgaaacgccatctctactaaaaatacaaacaattagctgggcctggtggcagttgcctgtggtcccagctacttgggaggctgaggtgggaggattgcttgagcccaggaggcggaggttacagtgagctgagattgcaccactgcacttcagtcagcccaggtgacagagtgagaccttgtttcaaaaaaaaaaaaaaaaaaaagacactttgagactgggcgaagtggctcgtgcctgtaatcccagcagttcaggaagcagaggcaggagtactgcttgaggccaggagttcaaaaccagcctgagcaacacagcaagacccctgtctccacaaaaaatatattaaaattagctgggtgtggtggtggatgcctgtagtcccagctacttagaggctgaggcaggaggattgcctgagcctgagaggttgaggctgcagtaagctatgatcatgccactgtattccagtctgggtgataaagcaagaccttgtctcaaaaaaaaaaaaaagagcactttgaattctcataatcataatcatatgacatctgtctaccttagaaaccctcgctggtgggtggtcacacataatgctggtggtctgcggggggcagatggactctcacaccctcctaggttcccctttaggaactgaggcttcaggtatgggaagggtttgtggaataaatggatgaaaatggaatgagaagctttgcccacgtcagagccaacctatcatgtggaccaggattcagaccacccctgggagaggaaccaggatgcacccatcattctttttttttttttttttgagacggagtgtcacactgtcacccaggctggagtgcagtggtgtgatctcggctcgccgcaacctccgcctcccaggttcaaatgattctcctgcctcagcctcccgagtagctgggattacaggcgtgcaccaccatgcctggctaattttgtatttttagtagagacagggtttctccatgttggtcaggctggtctcgaactcccgacctcaggtgattcacctgcctcagcctcccagagtgctgggattacaggcgtgagccaccgcacctagccgacacccatcattcttacacagtgaagacccagggagatgatgagtcacaccgggaagtgattcatttgcttactgttaagttcatccaggattcctttaaataccaaatccccatatacgcttaaaaatacctagttcactcagaaacagtgtgctgactgacggaagccagacatgaaagactatgtggtgcaattccatgtataggacgtttctagaaagggcctaatgacagagatggaaagcagatgagggcctgcttgggtctggggcgtcagtggggattggctgcaggcagccatgaggagccttcagggtgatgagggttctaaaagtgcgtcgtgtgcctgagccactgcgacattcactagaagtcctccgtgctgacggagggtgaactgtgtggggcccaagttctatctcaggaaagccagggaagccactcagttcagctttgtgaaaatcaagggagtcttcttggaggaagtggactctgagctggatgtgaatgacggagtgtctttggtaaggagagacagctgcaggggactcctggtggaggaacaggatcccgggggagcggccgggcgggtgactgaggcgccaatggaaggagaagcctgtcacaggtgagggcattgaagggaactgcagggacacccagcgcttctcaactctgactgcagatttccagctgccatttctaaaggacaggtgcctgggctccactcctggaggtttggatttaatcagtctcgggtatagatcccggacgttagtatttttaagcatatttttaaatgaagtgatactctaattctatcattttctttttacttctcagcttgttgcttctctaaagagatacctccctttatccattttgtggtcacccagtgggacagttgagagagaaaaggccgggtggcatgtgattcttctacttcatttaccagttttgaagatgatgaatttgtttcccatgaccttccaaaggtggttttttaaaatttattttaatctatcgtcgtgaactcctggggcgtgaacgtgtgtcataggtttcaaaccactgcaatcattatcctcattgaggttcattgtggctggtggtagtgtcttcatattggcctctgagaccttctgacctgattctagttatctttgataatttccttgtctttaaaaaattataattgtatatattttttaataataaagatgggtttcggctgggcgcggtggctcacgcctgtaatcccagcactttgggatgcagaggtgggcagttcacgaggtcaggagattgagaccatcctggccaacatggtgaaaccccatctctactaaaaatacaaaattaactgggcatggtggcgggcgcctgtagtcccagctactcaggaggctgaggcaggggaatcgcttgaacccaggaggcggaggttacagtgagcagagatcgcgccactgcactccagcctggcgacagtgagactccgtctcaaaaaataataataatagtaataataataataaagacagattttgccatgttgcccaggcttgtctcgaactcctgggctcaagccatctgcccacctctgcctcccaaaatgctgggattacagtgtgagccaccatggcccagcctaacttccttgccttttaagagtaaagcagttttatttcccattgctcttccactagctttaagtatgtgttaatttattattttaggttgtcctagaggttatgatctgcagactcattagatgctagtgatgctggtcttctttaaattggtactttaaccgcttcctggacaaggcagggactttgcatacagatatatcagtatggtgtggaagacagctacactcaccattataccacctgcacagatatcagtatgttttgaaagttgcctggagaccttggtggcaatccagggctgaaaactctgggtggggcactaggtgggtggcaggtgcactggggactgaatgggatgctgtggcagagaggaccagacctaaagcctttagtgaagaaggcctggtgtgaattttttagctggttatcaggttcatattttaaagaatatttttctaattacgtttgtttgtttggtctggcctgatgtgggacgtggtattttcagtgtataggtcttcctagagttgggaaggagggatgcccttctgttggagatgtttctgttaactcaggtgctttaggaatggaaaggaaagtcatgcagctcaggcccggcaggggcattgttgaagatcctcagccagtgaggcgccttccctgtgcccagcacattgctgaggaccttgcctgaaagatgtcctttcatcctccccacccacctgaaagatgagaagtggaggactgatgagaaccttccagatgggttctccaagccacacagctaacaggtgccagagtcggaatttgaactcagctgtgacttacttctgttaccagcagaagtgggtgagaaagccggccacagtccactaaacacgggctatgaccaaggtctctttgacaacataatccaacaaataggcttgttttagaatataaatctcaaggaatttggggggagttgatatactcttgttttttactttttattttgaaatatttttagattcacaggaggttgcaaagaaatattcaagaagatcctgaacactcttcacttagccccgcttcaatgttaacattatgcataacgatagtacaatagtcaaaccaggaaactgacagtgatgtagtcaacagaaactagtcagactccagtagttataatgtatgtatgtgtgtgtgtatgtgtgtgattctgtccaattgcatgtgcaacttcatgtaaccaccaccacaatcaagatatttaattgtatcatcagcaaaggactgcctcatgctaccccattgtagccacatgcacagtccctcttccatcattcctaacctatggcaaccactggaggacatttggagtttccagtttggggctgttatgaacccagatctgctatatgaacattcacttacaagtttctatgtgaaaacaagtttttattcctctatgatcaattatctacaattgctggattgcatggtaaattcatttttacttttaaaggagttgccaaactattttccagagtggctgtaccattttatattcccattagcaatgtatggatgattcagtttctccacatccttgccagcatttggtgttatcactgttttttattttagctattctcataggtgtgtagtgatatctagttgtggtttagattgcatttttctgatgcctaataatgttggggatcttttcatatgattatttgccatctgtgtatcttcacgggtgaaatatctgttcatcacttttgctcattttttttttttttttgagacgaagtcttgctcttgtcttccaggctgtagtgcagtggcacgaacttggctcactgcaacctccgcctcctagattcaagtgattctcctgcctcagcctcccgagtagctgggattacaggcgcctgccaccacgcctggctaatttttgtatttttagtagagatggggtttcaccatgttggccaggctggtcttgaactcctgacctcaggtgatcagcccacctcggcctccgaaagtgctgggattacaggcatgagccaccgcacctggcccacttttgctcattttctaattagattttttttttaattgttgagttttaagggctgtttatatattctagatacaagtcctttgttaggtacgtgatttgcaaataatttctcccagagtataatttttttttctgttatcttaacttgacccttgacagaatgaaagtttttaattttgaggaggtcaaagttttatcaaattttttccttttatggatattgtgtttggtgtatgtctaggaactctttgcctaatcattaaggtcccaaagctctttcctttgattttttttttctacatgtcttatagttttatatttaagtccttgattcattttgcgttagtttttgtataaggtatgaaatttatgtcaaatttcttttttctttttttgcctatagatgtgcaaatactccagcgccattaattgaaaaggctgtccctccttcatggaattacttttgctccttgtgacaaatcagttgggcatatttgtagggatcatttttcctgggctctctactccattccatttgatctctgtgtctctccctttgcctatatcacactgtcttgattactatatctctgtaggaagccttaatatcaggcagggtgatttccccaattttattctcctttttcaaagttatttggctattctcaggcttttctctttctaataaattttagaataagtttgtttgcatctacaaaataccttacaaagtttgacaggacttttgttaagcctgtcagtcaatttaggcagaatcgaccttttaactatgttgagcgttccagtccatgagtatgtctcttcagtatttaggtctttgatttccttccttgtcattttgtaatttttattttatatagatcctgtacatattttgttagatatattcataagtatcttcttgttatctttagagcaactttaaatggtgttgcatttaacagtcttgatttccacttctttgttattagtgtatagacatgcaatcagtttttgaatgttgatcttgtaccctgaaaccttactgaactatatgttttcctctcagcactgtctgagctgcatcctaccaacttggtatgtcgtgttgtcattttagtgcagttctatatagtttaaaatttcccttgagatttcccctttgacctatggattagttagaagtgtgttggttaatttccaagtatttggagattttcctgtagtttttttgtcattgatttctagttggagtccattttggtcaacatattctgcatgattttaatttttttgaatttattaaggcttttttttgtgacccaggatatggtctatctgagtgtatgttccatggacaattgaaaagaatgtgtattctgcagtttttgggttgaattttctataaatgtcaatttgatctttttgttggatggtgttgcacacttctgtatctttgctgatcttctgtccagtagttgtgtcagttgctcagagtgggtactgacatccccaaatattattgtgaatttgtcgatttttctcttggcaagatttgtttttgctgtatgtgttttgtggtctggggggtacgcatttagaatttctgtatgttcttggtaggctgggcattttattattatgtaatattattccttgtctttatttagtttctttactctgaagtctgcctggatattaatatagccacttttgctttctcatgattagtgttggcatgacatgtcttttcccatcctttactttcagtctacccatgttgttatgtttgaaatgagtttcttgtaggtagcttgtaggttattttttaaatccattctgccaatgtctgttatttgatgtagttagaccatttatatttaaaatgattattgacttgctagggtttaagtctgcattttatgatttttttccttctctttctcattcctctgtttctttttccttgccttcctatggtgacaaacattttttagagtcccacatttccttatttatactgtgtttgaatgtacggctttggatagtgttctttatgattgctgtaaatattatgtcagcctactggtgtcagagttttaccactttggaccctttaccctcactactttttaaatataattgtcttaagtatttcctccgtatccactgagtaccttatcgtatgacataataacttttgcttcaacttaaagtatgattaaagaacctcatgaggtgaaggacagtctagtcttcttctgttagtctctttttctgtttgaagacatttctttagcccttctttaaaggttggtctgctagtaataaattctttagcttctcttctcctgagaatatcttaatttctccttcatttcttttttttgatagcaaatttattgagtcataattcacataccatgtaactcatacctttaaactgtacaattcagtggtttttagtgtattcacagagttttgaatcataaccacaatctaatgtaataaaattgtaagtctggctttttgcatgtgatagaggggagaaggaaaagcagtctatatcatcttgctctggaactagaagttgatagtcttttcaagtgttttataaatttcaggttcctctctccatccctttatttttatttatttatttattttgagatggagtctcgctctgtcacctaggctggagtgcagtggcacgatcttggcccactgcaagctccgcctcccgggttcacaccattctcctgcctcagcctcccaagtagctgggactacagacacctgccaccacgcccggctaattttttgtatttttagtagagatggggtttcaccgtgttagccaggatggtctcgatctcctaacctcatgatccacccgcctcggcctcccaaagtgctaggattataggtgtgagcctccgcgcccggcccctttctttatttttaaaatgtattttaatttttagttcttaattgtggcaagagatacatacaaatgtatcatcttaagcattgtttaggtgtacaggtcagtgacgttaaggacattgacattgttgtccagctatcaccaccactcatctccagaatgatttcatcttcccaaaatttaacctctgcactcattaagcagtaattgtccattcccctcttttcacaccccctggcaaccaccattctactttctggctgtgaatttgactcttccaggtacctcacgtaagtggaatcctacaatatttttgtgcgtgactgacttctttcccttagcatagtgttctcgcaacgttgtagtaagtgtcagaattcccttgcctgtgaaggctgaataatactccaccgtatgtgtagaccacattttgtttatccattcatccatgatggacacttgggttgtttccacgttttggggactgtgaataatgttgctatgagcatgagtgtgcaaataatctcttggagatagaccctgcttttcattcttttgggtgtatactcagaagtgggattgctgaatgatgtggtaatttatgtttttaattttggggggaactgctatactatctgtccctgtcttttccttacaaacacgtgtggaagactttgaggcatttgacctgtggaacatctcccttcttattttggatgggtgcactcctggtgaagttcagcgtgtccctttgtcctctctctcctgcacattggcagctggatccagtacctttgctggacttggttccgtctctttcgcaggattagaggaagtgctctatgtctgttcacccatctttttgtgagcaggcagctgttgatgctcaatgcccctgttttgggtaaaattgtgtctccccaaaattcatttgttgaagtcttaagctccagcatctcagaacctgcccttatttggagaaatggtctttacagagcttatcaaagcaaaatgaggtcattagggcaggccctaatccagcatgcccagcgtacttccaagaagaggaaatgcggaagcagacacgtgcagagggaggatgggaagatgtggtgactccatataaacataaacacggctgtctcttgcccttcattcttgaacgctttgctggacaggaaatccttgagtgtcttaaataggctactctttttttttctggaggtaatcatggttgtcaaaaagtcttaagggtcagccacagtggctcacccctgtaatgccagcactctcggaagtcaaggcaggaggatcatcggagctcaggagttagagatcagtctgcgcaacatagggagaccctgtctacaaaaaccttacctttcatttctttttctttctttctttctttctttctttctttctttctttctttctttctttcttttttttattttttatttttgagacagtctctctctgccggccaggctggatccagtggcacaatctcggctcactgcaacctccgtctcgcgggctcaagcgattctcctgcctcagcctcacaagtagctgggattacatgcatgcaccaccaagcctggctaatttttgtgtttttagtagagatggggtttcacctataggccaggctggtctcgaactcctgacctcaggtaatctgcccaccttggcctcccaaagtgctgggattacaggtgtgagccactgcaccgggccttaacctttcatttcaaataaaaaggagataacctggaattctgtgtgggctctcagtgtaaagatagaaggacacacagagtgttttgaaacatgcccctccctgatcagcaggtgtcctgctgtgtcacatgtgactgtcagttcccgacccctcggccgagcagaaagggctttggcaaggtgtccggagttggaggtggcctctgggaggtttgctgcccgagggtcctgttgccgccaggactggtgaggagactgaggattgaaggggccaaaagctgacaaaattctgtgcgggggctgagtggcagattcgggtctgaatcatttcctggttcctggaatattcccacttaggtgccgaagccagaattggagggagcgtggcgcctactcatggagcctgccaaggcactgccagctgctcacaggccaggccgggcgggcagagcctcctcgctgcctgctggctttgaaattcatgtttgagacacacattccagccttcactgcttgttcaaggtgatacatgattttcagactggacagcttggcctcttgtctgttcttgtgttttcctttatgtaccaggataatgttaaacccttcccatgatgctgcaaaaaccaaatagtgcagcacacaccccacagcccgaaacaactgcaggtgcgtgtgccagtggttctgaaaggaatacagagacgtgtggtttccgaatccgctgattgttttattatatactgttacagatcatgttattctaaattacaaaataaaacttatgttaatatacatttatacaacgtatatattatacattatatagcatgtagtgatgtatgatgtaatgtatgatatgtactatataataatttataatatattataattattataataaaaatgactggccaggcaccgtggttcatgcttgtcatctcagccctttgggaggccgaggcaggagggttgcttgaggtcaggagtctgagaccagcctggggccacatagtgagaccctgtctttctaaaaaaaaaaaaaaaaatagtaatttgttattattcttcctattactatttttaagggacaattttggaaacatactttactttttctagtgtagcaaagaatttacattttgtcacctgaaagcgtcctggaaaatccatcctagtgtcttgtaattctaacagtcaccaggaaggctactttgagaaaatttcatatggtatgagggaaaacaagaacattctcatttttttttgtcttgctgaattaaaaaaaaaaaataaaagcaacaacaagaaaaaacaaagcccagggctggggttaagtaggtgaaggaggaaagggagtccccacctgccagtctcagtgccgctctttgccatgcacacacccgtatgtgtgcccatgtgtgtgcacacagacaccaccgggtccccttggagttaccaggcaaatgcatgtcatcagctgttgtgccttgatgtctcctaagctacatagaatcccctcagaccacgcctgacacccaggacaccagggcagtaatccgcacgcccatttcactctcaccatgtaaattgcgttttctattttcatttcattttatgtcacttttcttcaacaagtaattattctagggctttataagaacgctgtgctttcttagtctatttataatgagtaagaagttgtttttattctatttcttttctgtctgtgcttgccattttttttaatcacgattggataaggggggatccctgcaagataacagcgcccaccaaattagaatctccctgaaaaacatacagttaatcaggaggaaaatatagttgcccatagtccatgattatagcacaactaggggacaattaatgtagcaaacctctgtttccacccaagaccaggatacagggtttcagggccaggccagagccccgagccatcaggaccgggcacaggagagtgcagcagcggcctggtcccaccctcactcgggagataataagagacatctgaaatgtcactcaggaataaaagagagggtcttggaaagtgcatgggatgggagagtctgctcctgggagatgtttcctggaggtttggtgtgaaagggaagagaagaattagctgaaaataaggaacttagtaaaacaacaaatcatccacaaagaagagctcctctcaggggaggaggaggtggaagaagaggaaaatctctctccttaattaaaaaaactgtactttagagaagtaagagaagagtgcatggctgaaccatgttcctgagcaagccacacagacctctccctccctactgactctactcatcagcttttggggagtctaagtaaattaatataaacccaagcacacctagcgtccatacaatattactgtaagaaaaagaaatagaaaatgtgtagcaaaatgctggacatgaaaacagccaagaagcacaaatgaaatgtaagtaataggcaattgcaaatgtgaaaaaacaccatgagccagctcttcataaaataagactggaaatggataaacaacgggagatatgaaatgagagctaattaaggaaagcaaatgaagaaaagtctaagataatctctgaaattaatagtaaatgataaggttccccaaagggatagtagttacagctgaaagcacagtagggatagaaatgaaagaaatagaaaagatcaaaaccaaagtgtctgttggaaagacatccaatttacctgtaattggtgaccctgaagaactaaaacaaggcaatggaacagaactaaaaatttaaaactgcaagtcaagaaaactttcctaaaataaaattaagacccaaatctacatggaaatatagtccactgccattccgggaatggttgactcaagatttatgctctaggaagactaaattctaaagataaagagaatatcagcagggcctccaggcaaaaggaccaagttatttacaaaggaaatttacagagttgtttacaaagttacaagttatatgcaaagtctggtgtcagacttataacaacaacaaagaaagcaagacagcaatgcacaatacttttaagaaactcaaggaaagaaaacgtgagtgaaggattttatgcccagccaatggttctttaagtgattcagaaacaaaaatattgtgcccaccaggcacacttaaagaatcagctggcattagtgatatgtcagaggctggacggcagaaatggtctgccctggttgcaggcaatgaggagtttcatcatctgtcgataatttaaaaacaataataaaactgactgaaagtccgtctgctttttatgtcactgtgatccaacacttttaaacaatgtcagccaaaaaatactcctcctgaaaaaacctattgttggtctaatttctaagcaatttttcctattacaattgcattttaatgctatgtgtaaacctcaaattagcatatttgcattacttatgctttaataaacattatattctacatggcatttaatttggagaactcccaagtatacgatcagcccctgacatctgcagactgaggcacatgtgtttattttgagaggaagtttgtagcaatccagaatcatgcaaactccattgaggtccggactcctgtgaccctgtgtattcctctgtttggatagcagattaggaataaccagtgatatcacaataggtaaagacaaagaaacagaacttggatttcttcaattctgtcattctatgtgaacactagaggtttttattggtgtgtaaaatttgaagagtaagagcacagatgatgagattggatatttttgtttgattggtgcaacttgtagttgacacatgaaatattttactgaatatgagctgtaccattaggactgaaattcatcttttaaaattgtccatggtttttaaaattacagatccagttaaggaaatagtgattattactggttattatgtgataattactgaaaacactgttgtcacatagaggatgaaggtgttaaaaattagccacattatgtatgccacatagcaggggacaggcttcatccaatgaaaagatgatgtgggaaactttggcgaaggcactgatagtatttttacacttaaacaagtattttaaaatgtttaaaaaaaattgtatatgtatgaccgaaagaaaggtagggataagtatggaggaatggctataaatgttatatattctgacaaaatagaaataatgaataaaaataatagttggagtaggaagagcaaaagaggaacagagaatcagctcattgattgccctgcaggtaggaaagtggtaacattgtttggtatacaagaatgaccactgaaacaaaaatatagaccttaaatacccaaagaaatgcaaaaacaaaacaaaacaacttttaaagaagcaaacaaaccatatagtgaaatacacacggtcaatataacactaaagaatagaactgagaccaaacctagcagccgcatcagtaaattagagtggatttaacccatttattaaaaggcaagactgattttcagattggttcacatagtggcacccaactctatgctgtataaagaagtcatatccaaaacacagtgatccaggaaggctgaaaatgacaggagggtgtatagcaatgaagagagaaaaagagcttgggagttttaatcctgactgcagccaagctagtatcaggccaaaagcattaatggaaacaaagagggccgctgtcaatgctaaaggctgcaatttgcagagaagatacactaggtgtggttatgtctgcttcacataacatcaccagaacctctacgatgcggaaaccacaggggcggtggggagacatgagggacacgcagttccaggacattgtgactgccttgctcagcctgagacatgtgaaggggaccaaaacatacgcctccaaatgtaccagactttgtgctgtgataatagggaatacaactttgtttcgagactacttggaacacttaggaaagttgacatatattagcttacaaagacaacctcaatgagttccgtaacagaaataatacaaacaacattctgtgctcacaatgcaataaaactaaaaattaatcataagattaaaaaccaaaaaggcccttcaatttgaagagttacaagattaaactctattaaataagtttttaggtgaaaggaaatacacaaaccaagtgcataatttttgaatttgacgataattaaaatatatcactctgtggaatacacataaagctgtggttataacctcagaaatgaaaccaaacgaattaatggatttatcatctaactaaaaatgatagataaaaatagccaaataaacttagagtagaatgacaaaaaataagagtaagattggaaattcatgagttttaggaatgagaaaaaaatgaaactgataaatacacaaaatactacatcctagaaaaagaatcaagtggacaaacctctgtctaagctaatcatgaaggggagagagagagaccccaaacaacacagaataagaaatgacattaacagaacagagcatatttaaaaaaatcattaaaagcttactttgtatagtgctttgcaagtaagtgtgaagacctggatagaaagggaacttctttaggaaaatataatttattcagattgaccccagtagacacagaaagttttaaaaaaaaattcctactggaaaaaaattcaaatctatattttcacaggagaattctatcaaatcttcaaagaacagatatctcaatgctacttaaattattctagaacatagaaaaagaaaccttaagattattcaatgagaaaaccacacaccaatctcacttaggaatattgatgtaaaatgcctaagtaaaacagtattagagagaaccctttaaaaatggttttgagacaactggatagccatttggaaaaagataaaattttgtcgatatctttcatcatctacaagcatacatttcaaatgtctctaaataggtagttaccagaaaaactaccacaagaaaacatgggtaaattttaaaataacctgtgggtagggaaaattatgattcaaaatccaaaagcaatgtaaaaaagattgagaaatttggttgcattaggaaaaaaacaaaacaaaactgctttcgcatgatgggggagggacaccataagcaaagtgaaaaagccaggtaataaaccagtagaaaatatttgcatcttatatcacaaagctaattccttcaaaatatagattataacaagataccatttctcatgggccatattggcagagaggaaaaaactcaaaacaaaacaatacaagtttgatggcgccctctattggcgaggctgtggagcagccattcagattgctccacccctggaggaaacaggatgccttgggacttggtgcacctgcatagaccctgactcagccatgcctccttcctgaatttacctggaagacaatactccaaatccaaacatgctcatggcatatggagatcttaaattaataggtcctcttttatgtctttcaataaagtaacagatatgtttctatagaggtcttccatttttacattaaattgattcccaggtatgaaattttggctactgtcccagtggcagccctctggaaatgacctttgttgagtttgtgttttgacctggtatccagcaaccttgcttaacagtctgaagagcagcttggggcttttctctatggacagtatgtctcctgcatgtaatgacagttggctttcattcatccattgcaatcttcatcctttaatttctttttgttttcttacttctgtggttgggagtgacagaacagtgttaagcagaagcagttatactgcaaattcttgtcttattccttcttgtagggccatctctaatggtccaccatgaggtgtggagtttgctgtggacttgtggtagatcctcactttgttaaggaagtctccttctggtcctaatttgctaggagttttttctccctttaattgtgaatgcatgttgaactttatgaaatggtttttgggcatcaattgagatgatctgttaatgtgatgaattatgtgattgcgacaatagcttttctaatattacaccaagttgacatgcctgggataaacctgtatttcatcatgatatgtctcttaaaaattgctgggttcacttggctaatactttatttaggatgttttttcacctgtttataaatgagtttggcctataatttacctttcttattctgcctttcattggttttagtgtggagattatattagacccataacattcagcatctcatccttttctcttttggagagcaattaatataagactgaggtgatatgttcctcaatggtattgttaaaacttacctgtgacaccttctggttccagtgcattactagtggccagatttcaagtgactaattaaatttccttaacatttaaagtctattcacaatgaggaaataaaccttacctcatcagttggcttccttcaacactaccatttttcttctttcttgtgagtatgtgagccttagttcaggctgctataacaaaaatatcatagattagtttagagaacacacattcattcctcacagttctgaaggctgggaagtctaacgtcaaggggctggtgattcctggtgagggccctctgcttggtttgcagatggctgccttcttcctgtgctctcacatcggggagagagagagcatctctctcgtgacttttcttctcattcccattcatgagggcctaatttcttcccaaaggccccacattataatagcatcacattaaggattaggcttcaacctctgaatttgggaggagcacattcagcccttagcagaaccccacccccaagattttcctaagtgaatgaatagtcatcccccagccttgttcctggcctctaacagcattttagaaggaggtttctcatgactggggttggctgagatgggaatttcctgattccattggctgtgattcagccccatgccatcctgccagtaagatgaacacatgagtcatgctcagctgctagggtgcctggtgctgcttccagttcctctgggtgacctctgtccagcacataaacctcctgaagcattccgaatttgcggaaagtgagccaccctcccaatgtgtacatgtctgggcctaccttcctgctctcgtatgtgacaggcacacagcctttccagaaggtacctcattgcctagtacagaaatgctgaggttctcacaggagtgagaaccctactgactggctgttgtgtctctcccatacagtcgggtgtggagcagttggacccacatacctatctgcgcccatcctcagttgaaaggtagtgaacagcttgggctgtggactcaggcaggcctcggttcaaatcccagctctgccactcaggggctgtgtgtgcagataggctgcatctattgtccaaagccaaacatggggaaaaccaaacaatctctcaaaggggtgtggtgagggcttaggcaaaagactggtgtaccgtggctcggatggattagtttccattctccctctctctgtttccagctttcctctcactacaagatgagggccctgtccctcttgggcgtttgccaaaggaaggtctggacacccagcagctcattcatgtcgcttcccagtttgctgttaccatgttgcagtgcagaagccataagccgcatgatccgtgagcctggccctgcaacttggctcctccacacagcagcgtttgccttcattgtcacagatgactatgagaagatgcccttggtcatctttggtctgggctctggagttctgtagagctttgagccgccagagctaagggggtgaggcttgccccaggccggtggcacacccaggactgggcctggatgactttaatggtaggacagaaggaagagaaaggagctccccagagtccagctgctgggctgtgcagcccatttgcagtgtacttccaggagccttgatggtgaatgctgtaaaagggggaatctttcttccccacctttctttaaatcatagagctattgtgatggcttctgagctgcaatagaatcacccatgaggatttttgtttgttgtcttggcatgaagttcctgtcccttcacagtaatccggcaggtgcctcccagggcatggagtcattgtgtcacattcttctccaggactgcaggagggtgggcacagagttccacaacttgaaatgcagcagacagttgaaaggattctgctcacaccaggagttggattgtatttttccaaatgcattaagtattttaagcagcttgagctgcttaatgggcctgaaagcatttgattagtccaaagggctctatgcccggcaggtcaggggacaagaagttcttaaaatcctatgggtctgaccccttctgctctctctggctatctggctacaacgggtccccagggttgcagcaatagctgtgacctgcttatcttcccagaagtgctggaggcaagctgatccctgagcactgtgcctggagcactgcaggtgccctgcagccatctccatccacaccccctgcctggcctgccccgattccaggctgggcctcgggctcccctcccttcttcgtccccctcctcatctatctgtggctctttctctcgggccctaccaccaagccctctccttgccattctcttctgtccctcaagccgtattcctcagcatcacatggtcctcccgggtcccggtccactcctgtcatgtgagaacaaatggtgtctgctggaatttgcttcgggcctctgttgtgttttgagccaatgtgtgtggtcctcctaacgtcatttgattcatccggcaaaaggctctgctgcctgcctgtctggggcagagcttctaagaccctgtcagttttggacaatgaggcttccctgggggtgcagagtggtgaagctgtttggaatccttctcttgaggtggagtccagagtttcttcctgtcagttcctccccatttgtgtcagcagggtgctatgtccagcgcaggtcctcccctggcccctttctggccttgcagagtgcccccggccccgtgtgagcagatggccttctgggcggagcgtgcagtctcttggcagggcagccaagttgggggtgagatggacctagggctctctgaccccgtaggtttggcctaggctgagactctgagcaggtcacttacctctgggtcctcatgctcaggttcaaaatgagacagacagtggagttaagagatgatttttctgatccttctttgggtctttgcatcagttattttaaaaaaagagaaaagcaagccaacacaaccatcctcggctgattggtggagcagggcttacttatgtggctagttaaaagaaaatttatttttgaaagctgcatggagattttccgtaagcacagtaatgtgagccggggtcaaagctgtctttcagagacagggaagtgcagagatgttcaatgtaaattgtgccttttagctaaacacttggtagattcagcactggccgtgtaggtttgtcctgcttgttttgggggaaccagaaaagatctgattgaatttaatctgatttctgctagagtttggtcatgtaagatttgaaaaagtgaaccttcctgagccagagcaatcaggcaacaaagaaataaaaggcatccaaataagaaaagaagccaaactgtctgtcttcactgatgttatgattctatacatagaaaaccctaaagactttgccaaaaggctcctgtaactgataaacaacttcaataaagtttcaagatacaacatcaatgtagaaaagtcagtagcatttctctacaccaataatgttcaagctgagagccaaatcaggaacacaatcccatttacaatcgccacacacaaaaatacttaggactacagcgaaccaaggaggtgaaagaaatcagagatgacacaaacaaatggaaaaacattctatcctcatggattgaaagaatcaatattgttaaaatgaccatactgcccaaagcaattgacagattcagtgctcttcctatcaaactgccaaggccatttttcacagagctagaaaaaactattccaaaattaatatggaaccaaaacagagccagatagccaaagcaatctgagcaaaaagaaaagccagaggcaccaattaccaaacttcaaactatactacgaggctgcagtaaccaaaacagcatgggactgatacagaagcagacacacagagcagtggaaccgagtagagaacccagaaataaagccacacacctacaaccatctgccctttgacaaagctgccaaaaataagccatggggagaggactccctattcagtaaatggtgctgggatagctggctagccttatgcagaagaatgaaactggatccctaccttttaccatgtaaaaaatcaactcagttggattaaagattcaacctatgagaatcctagaagaaaacctagagaaacatcattctggatattggccttgggaaagaatttatgactaagtcctcaaaagcaattgcaacaaaaacaaaaatcaacaagtggaacctaattaactaaagagcttctgcacagcaaaagagtaaacagacaacctacagaatgggagaaaatacaaactatgcatccaacaaaagtctaatatcacaactctacaaggagcttaaacaattgaacaagcaagaaccaaataacctcgttaaaaattgggcaaaggacatgaacagacacttctcaaaagaaaacaggtaagaagccaacaagcatatgaaaaaatgctcaacatcactaatcatcagaagaatgcaaatcagtaccacagtgagataccatctcacatcagtcagaatggctatttttcaaaagcaaaaaaaataacagttgctggcaaggctctgaggaaaagggaactcttacacactattggtaggaatgtaaattattcagccaccttggaaagcagtttggagatttctcaaaggacttaaaacagaactacatttgacccagcaatcccattcctcagtatatttccaaaagaaaataaatcactctaccaaaaagacacatgcacttgtatgttcatcactgtggtattcacaagggcaaagacacataatcagtctaggtgcccatcagcagtggactagataaagaaattatggtacatatacaccatggaatactatggagccataaaaaagaacaaagtcatgtcctttacagcaacatagatgcagctggaggccattatcctaagcaaattaacacagaaacagaaaaccgaataccacatgttctcacttataagtgggagtcaaacattaggtactcataaagatggcaacagtagacaccaaggactactagagggcagagggtgacagcggggcaagggttgaaaactaactgttgggtactgtgcttgttacctggatgacgggattaatcataccccaaagcttagcatcacacaatatacccaggtaacaaacctgcacgtggactccctgaatgtaaaataaaggttgaaattagtcaaaaaataaggaaaagtgggccttccccgccccccacacttataaagagttaaggattttgtgtttattttaagccatgttgaactcagcccaacatattgacacaaggcaggacttagtgcagtgtcactaggctttaattttgttgccctttgggctaataaagtcaggttatctcactgggctgtttccttatccattaagacatttgatgtaactaagtacccatcctatggtgacataaactttttcttatgtcattggaaagtccagaatacctggttgcaggcaaggtttgatctagcagcttgaccttgttagcacaggtccagtttctttccctcagtcctccctggtattttatcagcttcatcctaaggctggttcagggaagatattctgatgatatatatttctgctttggcaatggaggatttatattcgattgtcagaagtcctcatgtcctatttaaagtctagtcattggaaaataggttgataaggatggacctgaagaaaataaagcagcaatttgtcatgacaaagcaagactaggaagaggcattggaccagcatgaccaattcaaggacacgttgatgatgtcttcagcgcaagtgttcttcccaagcttgggggacctggcagggctgcctacagggctggtgtccagcctgctctatagaaggcgaattagagatcgcaataacgggccagcttccatgatgaccccaggttgtagtgatgtctatgtagaaatgaaataaatgcataattaaaaccaaaggtaggcttgcatttgggttgaggtcctggcacctacggaggccacaagtgtgtcagggtggaaggtaacttggtgaaataggaagtcactgcctattgcccactcatgtccccactgatggagttagctgggggatcccctggtgcagaccctggagaggcatcactgtcttccttgttcagtgggcttgggtcacctgcatgaattctgaggttgggaaggtgtaaacatttccctcaacacctgcagcccagccgccgtctccctgggtgcttcagtcagccgtcacgttggggaggcgtcatgtaaggtggtccttgtctgagtagaacctgattttgaaaatgaaattcatttccttgccttcattttccagacgaaaagatatgtatttgtggtgtgtgtgtggcgggagagtaattggctttggttttgacaaggaggacaccagagtcctgttctgatactcagttttgggcccatgcgtgacaattctgtgtttcttttcagcatttgccaatacattattttctagagtctctcccagcatacggaaaaaccccaaattcaaatttgacttttctcttcgaggctggttgtggcatgctgaagctcccaaggcatgtaatgtagtgaacaaggtggcctccaggagcgctgtcggctcatgggccccacccacccacctcgcggtgtaggaggatccaccaagtcactgtcagagtgggttggagagacctggcctggggtcagctctgtgggcagatgggccctttcccccactgggtggagtacgctccttagtagcccaagacagaacattgccttctcccgagaaacccacctctggggaaggttaggccatgggatctgcgggaagggttttaggagtagattaatgggatttgtgatcccaagcacccaggccactctgtggtccccacccctgggcttgagtcctgctgaggtataagtggtgctagaagacctctgccctgccctgccctgccctgccccaggaacctggctttctctgggctaatgagtgtcctctctgaaggtatccagaggccgtgcagacactcacactttggtgtgaggcgtgccctcggttgatcagttacactgctgtggggtgcacaggtggcaaggtgggggattctgggatcggggaggctagtctgggtgtagggtcctgccctggaggggctcacagtggggttgaaagcaagctctcgaggcgttattattcgggactctgagtgccgggccatgctgggggagtgagggcagggggagctgcggaggcagggctctgagggctttagaacaagagccggtgtgtgtttcccactgagtacctgccggcacctcatttatgccacgtagcaaccccatgacataggcttataggggactataattatccccatttcacagctgggagaacctaggcttagtgtcacagaacctaggcttagccactgggtggctgatactgccacccagttctgagccagtatcagcttccagccccctgactcagtctctctgctgtggtttcctctcaagtgccaggatccttcctggtcccgtttccaactcagaccagtggaggggcgcgctgtggttaccactcattagaagagaggcagggtctctctgtctctctctgggtgtcccccactgccatctctgggtgctgggggagctgctgtatatctctctctgtctatccctatctctccctccactgccatctctgggggttgggagagctgctctgtctctctatctctctccccccccaccccactgccatctctggagtttgggggagctgctcgctctctctcccccctcccactgccatctctggaggttgggggagctgctctatctctctctctctctctctctctccccccactgccatctctgggggttggggggagctgctctctctctctctctctctctctccctctctccccctccgccaaccactgccgtctctggaggttgggggagctgcctgggatgcagagcggcttggattggtgctccctctgcctcagtggttgagctgacctctgtccagtctgtacacattggatcctgaggctgagcttgggtggctgtggcaggaaggtttggtgacatcacacccttcaggcttgtgtctgtctgagccaggctctgactggctgggagaagaggaggaggtggggttctgggaggccctgaggctgagcacggctgctgtgctctgtggctgcactgcaggggcacgggctcagcatgttctgggccagggcacacaatgctttcagatcaggctccagcaccccacacgccccttcatgctttgcactttttgtctaccagccagagggcagtgaataatgagaacaaacaacatcgggtccagattttcgtggtcattttcctaacaagccgaggtcagagagcactgaaaggaggcctaagtgcttctgccacctcagctgactgtttttcaaaaaggaaagcatgcgtgggatgtgtgtattaggtgttacggtgatgtctgttgtcagatcatggccagaaaaggggttgtttcaattaaaatggattttggacttcgtttttcttggaatgagtaaattgagggaaatagcacatgttgagattttggatttctgctcttagaaaggatttaaaataagtggtcttcagtagttccacagcggatcttcgagactggtacagatggggtctcctggatgtaacgagttcttgctgctttaactggatccggttgactctgtctgaccagctcagctggttcgttctatgaaacgcacttctgctttctggaatctgaaggaaggagagagatagaagacaaagaaggacagatgtgttggtggccagaccctggcttctgaacagtccttcctgatggcttcaggacctgggaggagcggcggagcaggtggctgccctgggcttgccagacacctccattccagcaagatcctcctgggggatgtggtgccctccctgcctctcaggcacaagcatatgcttgtttggcctaaaaaagtctccttaattaaaattaatatcgtaatgcagtaaatccttctgcctcctcttcccctgcccagttacaattcccggcggctctccagcccatagaggaggcttctcaaagtttcctgcctcctggaggagagaagccattccccgatcacccaaaaggacaaagtatgtgcccactctgcgtccttgcttgtcactgcccaacatctgcaaacattaactaaagtgctgagcccattcaggtgtaggactcactagttggttaatgtgacagacagcgtttcctgtgccagcgctggctggtcacttcctgtcatccagcactcttgagtgttgcagtggatgcctgtttcgtaggaacactcagcctgttccgtaagaaggagcgccacttctcagcctgtacttagcaggtcactactgttggccactctgcttttctttttaaaattttaattattaaaaaaattttttttgagagtttccctctgttgtccaagctgaagtgcagtggtatgatcttggctcactgtcacctctgcctccctagtagctgggattacaggtgtgtgccaccacgcctggctaatttttgtatttttagtagagacggggtttcaccatgttggccaggctggtcttgaactcctgacctcaggtgatctgcctgccttggcctcccagagtgttcggattacaggcatgagctactgctcctggtccccttcttatttttatgttagtctttggaaacaattggcatatattttagtctgtttaggttactgtaacaaaataccataaactaggtggtttacaaacaacagacatttatttctcacagttctggatgtgggaagtctaagatcaaggcgccaacagatttgctgtctggtgagggcttcctggttcatagaaggccatcttctcactacatcctcacttggtggaaggctcaggagagttctctggagtctcttttacaaaggcacaaatcccattaatcacctcccaaaggcccactgtctaatagcatcactttgggcattaggttttaacatgtgaatttggagaagggcaggcacaaacattcagtctgtagcagcatacaaaaatgtaacaagaataatgtgatgaacagctaggtatccacaagctgctaaaggtagagaatactaccatattggttacctatttctgtgtaacatattatgccaacacttagtggtataaaacagtaaacatttattatctcacacatagtctgtgggccaggaatatggaagcagctgagctgggtggttctagtggaggggaaagatgtgagctggggcacctgaaggcttgactggggcaggaggatccacgtccaagatcgacttcacctggctgttggctggcaagagggctcagttctttgccatatagacctttccacagagctgcttgagtgtcctcacaacatggcaggcggattcccccagcctcagtgattcaagagagagtatagagagagtagagaggaagccgctgtgccttttatgacctggtctcattagtcatacactgtcatttctgcttatgtctgttcactagaagcaagtcactaaattcaggccacactcaaagagaaaggaattaggttccactctttgaagggagtgtcaaagaatatgtggagagagatatatatatatatatatatatattcttttttttttttttttgagatggagtctcaccactctgtcacccaggctggagtgcagtgatgtgatctcagctcaccgcaacctccgcctgccaggttcaagtgattcttctgcctcagcctcccaagtagctggaatttacaggcacacaccaccacacctggctaatttgggtatttttaataaggcagggtttcactatgttggccaggctggtctcgaattcctgacctcaagtggtctgcccgcctcagcctcccaaagtgctgggattacaggcatgagccaccatgcccagcctgtggatgtattttaaagcatcataacaccattgcagctagagcccctccccagttgcatcttgtctttcacacagaggtaactactgttgaagtttgatccttgtttatggcctagtacatgtataagtatttctatccctgttagttctgcattttgtctgtaagcgttatgtaaatgatatcaccttgtatttttttctgtagtgtgcctttttttttttttgagatggagtcttgctctgttgcccaggctggagtgcagtggcgtgatctcggctcacggcaagctccacctcctgggttcaagcgattctcctacctcagcttcccgagtagctgggattacaggcgcccgccactgcacacagctaatttttgtatttttggtagagacgaggtttcgccatgttggccaggctggtctcgaactcctggcctcaagtgatccgcctaccttggcctcccaaaatgctaggattgcaggcctgagccaccgcgcccatccagtgtgccttttttgcttaacattatgtttgtgagattcatccatgtgaaaacaggtggctgtatttcatgcattttcactgctgtgtggtattgcattgtacaaacataagactatttgtcgttctccattgatggatgcttagttgggttcctgtgacttgctgctacaaacaaggttgtcttgagtactcaggtatgtgtctctctgtgaacgtgagctggatttgtcagtatatttagcaaggattggaattgctatgggagagagtacagtaatcttcaaacgtactagaaacagctaaattttattccaaagtgtgtgggtgtcctcatgagtggtcccactgacagcgtatgagtttcctcttctcctttttcttgacagcacttggtgttgtcagacattttacatttttgtctaatgcgtgaaagtgctgtctacatgaggtattaatttgcatttccctgcgtgccagtgaggctaacatctttccatgtatctattttcacatatatattttttcatatatttggtattctgtgaatgactggccatatcttttgcacctttttttctgttttcttattgatcaatctgatccgttgttgagtttatgtaccataaatatcttttttcttttcttccttctaacataatgtagaagctaagagtgtggattctggggccacattgccagggttaaatcccagcttcaacacttcctgtgtggccttaggcttagtctgtgtatgcctcagtgtcctcatctgcaaaatgggatgatggctccccacggtgggcctgggaggatgcgcaggttcgtatctgtgaatcagttagtgcctgtcatagtaagcacaagatagactaatgcaacctagtgtgctgggccctgtgtggccacacggggctgtatgcacaggcgtcaccatggccagagctggagctcagatgtgtctgagaagattggcagatgctgcttcactctggctcccggtctcctgggtggccctgcttccatccctgagctgcctgaacggaaaacgaaatcccatccccgctccagggggtgcctgggaattggaaggcatcaggctcctcacagcaaaaatagaagcctcatttgcttaggagagaacaatgacgaggaggcaagccagcagaggcggccttggcgggctgtgtacaccctctgcttgtctccgcactccctggggtcagacgtagacgtggctaagctgcctgcagaccttctcttccccttcatcctggcctgcagtgggcatcagggtccatcctgggacgtgggctgtcttggcaccaagttccagttcttaatacctcagtgtcacactgttccctgatttctcaaagccaggaaggaattgcagaaaacaaggtcagtttagtatcgagaatcactggagagccgtgtcagagccctgctgagaagggcgcggggaactgtgttcctgtctacctgatgctgtgggctgcacaaggacggacttactgaagattacaggccagggggaagagggcacgtttagtgtcaaccctacacagaagaagttagctccgctgggcgcggtgggcactttgggaggctgaggcgggtggatcacctgaggtcaggagttcaagaccagcctggccaacgtggcgaaactgcgtctttactaaaaatacaaaaattaacctgttgtggtggcatatgcctgtaatcccagctactcgggaggctgaggcgggagaattgcttgaacccggggtgggagaggttgcagtgagctgcactccagcctgggcaacggaaactccgtcttaaaaaaaaaaaaaaaaaagaacaagtcagctcagccccactgcaaggagctcctgggtttatttaagtgagcctcagataactttacataaaagcaaatgtgtaaaaagcgataaagtcagatatattgaacatttgtcctgagggcaaatttctgagctctaaaagccagtttggttttagataacatctgtgagtctggaaacaggctgagatactctatatctgcactcccaactctgcctttggctttgtgagccctgtggtctccttgaaagaattggtccccagtgggtgaactaatcacccatgaagagtctcccaattcaaatctggaataaaaagtgaggacatgggggcagaatgttactcatcacatgtggcccgtcagtactagacttcaaggtaagtttccaagaacagagctctgtgaccattttcatgatagcaatttgtacattattactaagtaattttaatgccgtgtttacaggccaccttcccaaacaaaacaattgtttctggaagttagactcttgaagacttaacttttaatccagtttgttctcaaaacatttgcacaaatgagagtcttgaggtttgagctttctattctaaaggctcagcttcttgcccaggagaaaaataatacatgctcgtgtttataaataagagttatggcattggagtcctttacattgcagccagcctagggactcagttattcagaatttaaacattttacttgtaaagagcactttggtatccaccccaagggccctcctctgcctgtctcagcaccatctctgtgtgtcccatcaggaagcaacagacaactccctaagccccacagtaaaaacgtctctcctggtctgggggcgcatccatcccccatgtccccagtcccatcctgggtgttctgggattccagccacagctgtggggacaccgccatctcactgcatccctcttgctcttgcggcagcttggctgagctacagggccgggccgcaggaggcgtccttgtgccggagctcaccttgtgccggagctcaccttgtgccaggtgttgagctctgccagctgcccggccccactgtgaggccgccccttgcaggtgagttcactggcagcccagccagcccacgaaggccatgtgagtgtgaacccccattacaagctttccctcatgagatggcgctgatcagtctgggggatacctgcctttcagtatgggctgcagccattaggctggtaccaggaggagccaggtcgagctggcactggggcgacgctctgtctttgatgcaccctgatgcctcccccatcctgctgaccatggtgctcagcacagaccccttccaacccatcccagggcctctgctcagtgtggccagagcctcctgtcaacaagtatgtcactgccttcgggttattattgttcaccagattccacttgctctacaacccaggcacagtgcaccagagtttcccaaacctgtgtgccgagtgccagccccttagcaagtgcagcgttgcccatttcactctgggaaatgcagccatagctctggggccagctagaggaaggagtgtgattgtgccttcccgggacagcttccaggtctgggagtctgtgatgttgtgagtgttgccttagctttgctaagaaaatgcttagggagatgggttccttcacccattcttccactcatgtgcctttctggctccagggctggtgtcccctgctttggaggggacgctcacatgagctgccctattggggttccgtcaagtttctcttagcctaagcggcttcctgtctcgggctccctccccagccatttgggtcaccttgggtccctgaggatcgcttctggatcttggaccccctcaccaactcctgtgacataataatcaaaggtaatcaggaaatgtatgaatcgtcttctttaaggaatatttagcatttctgctcattccagagtccctggaagcatggcatttcaaaggcttggttagatcacaagtccaatttactgccagaaatttgcacgtagaataatacagagcctatgatggcagttgaagtggtatcctgtgagaaaattaattagtcctgaaactaaatgccgacagcctcagcaaaatattcatgagagaagcaaacctcgtgcgtggtgtttgaagtcaggcagctgaggctgtgtactggacgtgttctctgtggctgagttctgctgtggattctgggctagtctaggcaaggcctgcctctccttctggactggctcccagggctgggggctcaggaaggccctgcaccctggagaagaagggagcccctgagactctttggccttgtatttgtgtgtccctctgggctgcagggctgcagaataaaccagctcccaatcctccaaacaaaaataaagacctgtgaatggctacacttggagagcagagtgttttgatatcatggggagacctgtgtacttaatttacggcctgaagattgagaaggatttaattgttccaaaaatggtgagaaaagagcaggtcccagcctttctgtctgatcacaaacagccgagggggactggggaagtggcctggtcctcactgcccctggaggggcaggaagaggatggagtgatgtgcttggcagatgcaggaatggccaggcagtgggaaaagcctagggtttccaagccatgtctgatcctctgtgttccttctgcctgctgggatggagcccgccccccaaatatgcctggctcacttacgactcagagtcagctgcccccagggacttcccggctctcgtgaccttgctgggcatgactttcaggggagccctctgtccaggagacataggtcactcgaatcacacagccgtgctttagtgaatgctagccaggggccctggagagggcaaggacaggacactcctgcatggaaacgaaaatgaatatttttctctgcagaaaatgaaaagtggtgctgggtccaagtggtaggtgacctggcttttgagcgaaaatgctgctgggaaatgagagaaaagaaacatgaaaagaatgcaaatgagggtggtggacaggggcccagaggcctgattcctccaccctccgcaaaggctgggtgtgtgatgcctataaatagacactcaaaacccgttctaaatggagtgaagacatgggcctgcttcctcttatggaaaggccttacataaggtgcagtgctgctattgctcctgggcggtgtgatgattctgtgcctttgtcggaagtcagtgtgaagcctgtggggcttctgggggatgcacatggatgagctctgggctttctggagactcgcagactctgggaaggaggcggtgggcgatgggcaggtctcctagggctgggaaacagtcctgagacaggctccgggtttcctgaggcgcttctgggccaggagcaagtgggaaaagctggactgcagggcttggtcaagtgacagctgcccagagccggagtttagggtgcctggagaggacaggggctggcaggcctgactttctcactgatccacttggggtcacagagccaacctgtaacagagtgaggaactgaggccgcattgctggactcccagtggaggattcttgctgctggactaacctttagttcatgaactcacccagaaattacttatttttggaggaccgcagatggcgagcttaggagtgaagaagggaatactatttgatgctaatgtgattccaggcaacattctagaggttcccttgcaattcaccttcccagccacctttgaagtagttattggccagttttatacacgatgaaactgacagagatggtgtgaagggattttctgacgttcacacaggaagcaagcagcccatgctgactccactgcggaaagcgtgtgtgtgattgacatgctttttgtgtggtgctcactttgggtgtgataaagaggcctccttgcaaagggccaggatctgtgaagcaccatgttgcttcacagaacaggccgtgaaaagccacagaagcaccatagcctgggaaagaaatggaacaacggtgcaaacagccagtttcccctgagcagaggcaagcaggttacggctctgcagctcccttaacgggtagcttgttcaacatggaaacatctttagcctcctcagagacgttgggtcatctcctttacatggggaccagaagtatcttccctgggccattttgggtggaggaaatttcgtaattataaccctctgctaggggtgtctacctaggaagtgagagcaactggccgctttcttagagaagtgaagacgctgagtagactaaacctttgtgatgaagtcgaagccactgtgttgcctgtgtcctgtttccttccccagtgaatggggctcttccctacgactgcagaccccaggaccagattgcaggtgccctgtccagcagcgcagccattcgtgaagggctcgcagcctggcccggctcaacagctgatgcccccgggaggaggctgtattactatcctttttgaaaggaacacagaaagccctttgtaactttgtctgtagccaacatggagggagaggcagaattcagatgtgatgttgcagacaattgaacacccctcctcctgttccaccccagcttcctgcccgtagccttctaatgcccttgccctgaattcctgatccaacccaagggcctggccttgaaacccccgagcctgctggcagtagcttcctcttcagccttcctgtgcagagcttcctctattcagggaagtctgagacctggtggcctctttctcattcttttcatgaaaccatcttgcccaggagaaggtgggctgagaccctgggcattggaaaggagaggtggtcctccttcctctcttcactttcatcgcagtcctctccccgcccacccccatatgcacaccctccgcagtctgaaagtgtcgtgaagcaccagctctgcaaacccgtggggtcaagctttgttgtgggaaaatacatattcatgagggctttgaggagcctcattaaaatgcagagagtctctcctttcagaatggtacataagccatctctttatttgcccaacacattgttcttaaggcaataattatgcgatgaatggctaaagaaacattttaattatttgtttagggtaatttctgattatctcattagaattataatctgtccacttttacaggtgattcaaagcctcatatttacatttttatacttgaaggagctctatgtgcgcacctgtatcattgctgaagtgaaagtaattttctctgttttcttctgctttattccagaaagatttgatcaccaggagatttttcgggacattaccaaaccactcattttaggtaagaaatacaaggcagcgttgcatggaatgaggttttgcttttgccatgtggggagcggaccgtttcactggagggaaaatgctacattgcaggcagagctggcaactgccgtggctctttgttttctgggatcctgtgtgtgtgagcttggggagtttgaagctggggtttgagtcacagccaaggagtggatggacactggggacgcttctggcacttaccttgcccggaaccgacctgcccaccacccaatgacaacacagcaagacacgcactccccatctgtcctctcctcattatactggtgtttctgtaaaccatggtcctcaccagactcagtcattgatttgtgtaacccctacctaggttcctagttacagcgaaagtagacacatgtatatcggcaataataggtagcactcgaacctttcactctccagtgtgggcagtggctggtctactttgagaagggaccagccattgtgagataccaggaagctgagcagaagaaatctaactttgataaaaagaggcctcctcatcttgccagggatggagcgtggtccatcctccctccctgtgcatggagcagtattgcagccctgaagacactgccccatggtcagcatctggcttgcccttgccctgtaggactggtaggaacagagccctggtgccagccgagtgttccacacaggggagacttgcaagggacaggttctgcactgcagatgaattggctgtcttcttctgtggctggagacacacaaggcagcggctttgtagggaaactggtgtacagggtggggcgtgtttggagaacgaggagcagagggcattgttgctggagttaaagaagcagagccagggatggtcttcatgtcctgatgcccagagcaggcctgagcttctgatggattctgggggttcttatgtattcttgggaaggagcatgtggtaagcttggacagggaggcagttcagagtgttacatgcaaggcagcggtggccttgggaacaccccccctgcctgaccaaggcaaggaacactttgtgtgtcccagtgtggaatctctgtgccagttgtgaggggacggatgaagaccagcaggggtgaggacgggattctggagtgtcaagactcaggttcagaatcacagtttttcttccagggcagcacaaggccacaagtgtggctatttgaagccacccaaaaagccattatttgtaaagcaaggcagctttattgatttcactttctgccctgcatctttcccacattgtggtaaccactcaccatccctgttctgctgatgaggcaggaattcccttgcatccagttggggagcattcttgtcacaaatgtcctggatgaattacacggtggctctccgtggagggagcacattcacaaggcatttaagagatgcaggacaatcagccctcgtccatgaaacagggtgaaacgtagaagagctgcgtgattattaatgggtttggacataagctggagtgtttactgaaatttttctcagttgtcagttttcaaagtttgtgaatgtacttttgtgctctcaacaggccttttctgctctatttaactttctacttagggttgtaaacatacttcagccgtaatgacattagatacatcatccactctcagctctgaaaatgctggagattttgattatcaccagcagtaaggacagcttatgaagggagatgttacttatggagacacagctcatgattccataaaattccagtcttctgggagcccagggttaagcagctgcctcagcccatccaccctctagggactgtccacggtgaaattggcttcttgacgttttccttatggaacctggggtgtcattacattctgttagagtcatagggtggttctatttatgcctgtaaggtataaggtatttttttcttctgagtctagaaaagacctactggaatttttatgtatcctgaaatactattagacgatcaaaatcaattgcaatagagaaggtgctgggctctcttcccaattgctctcacccatctgcagtgtaataggcctatcatgtaagtgaatatactcatcacaattctctgcagcttcccagcagaaaagcatattccttctcagagagaaaggcggcaaggagatggatatttttaaatgccaattatgccagaatgagtctctgtgaggagatctgtaaagagaagaaagggccggggtttatttatttttctgctgcgaatggaatcattctgtagcttcagaatactaatccctgtgatgtgcctgatgtcttttcataggataatttgtgaatgtgcttccacttacaggaaaagtttgaggctcttttcttattcttctttttcttttttttttttttttgagaattaaattctaggcctcactatatcctatgataaccgtcctataggccctcgatctataaaatgtgtgcataatgaaatatataaaatcagcgattatcctgaaggaacacagaaaagattaataagctgtatttaaatcacggcaagtctcagaacatatattaagttagaagacatcacgtcctgaaaatgacgggctgatgtgatactagcatgtacccccgtatggatgcatataaatgctgtgtaaaacctagcccaaagtgttctttaaaacctaagatccaaagaaaggcatggaaattccaagctatgagacatgaagagaaaacacaaagccagagcactaagggaggaggccatgagacccccaagcagtgaggttcctgatggagagccaggatgatgaagactgtgtgacatttgtgcagggagagacacggcaatggctgggacagggtagcaaggctaggagcaagtgctcatatgtataggaagccaggaggtggcagacgtgtgttatggaccaggtgggatgtgatgcaggacagctggttggccacataggaaaagagaaaagataaagtgagatccctacctcacagcacatgtaccagtaaacggccatagaattaaaggcctatgccgggcacggtggttcacacctgtaatcccagcattttgggaggccgaggtgggcagatcacctgaggtcgggagttcgagacgagcctggccaacatggcaaaaccccatctctactaaaaatataaaaaattagctgggtgtggtggcggacatctataatcccagctactcgggaggctgaggcaggagaattgcttgaacctggggggcggaggttgcagtgagcgagatcatgccactgcactccagcctgggtgacagaatgagactccatctcaaaaaaaaagaaaaaaaaaaaggccaaaatgtaaagacaaaaatgttaaaatacatagaagattttttctatctgctcttgaggtgggaaacatacacacatcataaaagaaaagatggattaatcaaacatcagtattagcaacttctttaagagaactacaggctggaataaatattcatgatgaatttactgtgagagatttgtattctgtttgtatcaagaactctttcaaattaattttaaaaagacaatagaattgaaaaatgagcaaatactatgaagaagaaaaaatgaaaatgtcaaatagacaaatgaactctgccttgctcctaatctgggaactgcctgggagaccatgagatgttggcaaattagaaagtctgataatcgaagggttgcccagagtgtgaagcaagggggccttcatgtcctgtttatcaagggcaagttagtaaacccctttagagaacaattaggtgttatctagtaaggttgaaatgtggatcccccatgacccagcaattctgctcatgaaagggattcagtgttgtattagtcagttctctcaaaaacagaaccaataggatcagtttatcttagagtttatgtatcgatcaatcgattgattggtcaattgatataaggtattggcttgcatgatatggcatctgggaagtctcacaatctgccatctgcaagctggagacccagggaagccagtattgtagtgcaaaggcctggaaagcagagaactggtgcagattccagtccaggccgaaaggcctgagaaccagcagcatggagggcagagaagaccaatgtcccagtcaagcagtcaggcagagagtgaattcaaccctcctctgctgttttgttctatgcaggtcctcactggagtggacgatgcccacctacactgaggagggccgtctgctttactcagtctgccaattccaatggtaaccgcttccagaaacacctcacagactatccagaaacagtgtttaaccagacgcatgggcaccttgtggcccagtcaggttgatacataaaattaaccatcacaagtgggtcacaaccagcgttttctaaaaatatgaaccagattagaacagaagatatcagagtttgttctgcatagtgaatgatagtgatcctgagaagggggactttgaggggatgggactgacagcgatggttaagcctgaatggaggtttgctacattgttttctatacttctatgtatttgcaaagttgaggagaaaagaagttgtggtaaacccctggatgtaggcacacggaccccagtgttctgtgctgtgggtccctctgatgcagccgtcttgctcccgtcttgctggttcatcctccaccttggctgactacctggcctcacccttgtacaggtgcttctgtttgtctcttcattgaaatgggtgggatttattgatttatttagagacagggtcttgctctattgcccaggctggagtgcagtggtctgatcatggcgcactgcaaccctgacctccagggctcaatcaaccctccctccttggcctcctgagtagcagggactacaggcatgtgccaccacacccagcttatttttatgtattgtttttatagaggtgggattttgccatgttgaccaggctggtcttgaactccttggcccctagaatgctaggattacaagtgtaagccatcattccctgtgtgaaatgagtaggatttctgaatgagccaggctttgcacattgacctggctctgcctcttgaactgctgccttcacatgggaggctccttctggccctgcctgtgtggctgattcctctctcaggtgcttctctttatcttcacagacgaggctcatgggcttcactttttgggaccttaggtggacatctgagtccacagccctcctgcctggcttctgtctctgtggatttgcaggcctgcttgtcccatatcctccagtgcccagcccagtgcctcatgtacagtggatgctcaagaagtgtgtagtcatcacatagctctagtttcttatttttatttttatttatttattttttttgagacagggtctcactctgtcacccaggctggagtgcagtggcatgatcataactcactgcagccttgaactgggctcaagcaatcttcccacctcagccccctgagtagctaggactacaggtgagtgccaccatgcccagctaattttaaaatcttttgtagagagggcatttcaccatattgttcagactggtctcgaactcctggcctcaagtggtcctcccacgtgggcctcccgcagtgctgggattacaggcatgagccactgcctctagactttagaaatgttcagaagctcaccttcccatctgcaaagtggagactcatgagttgggggcgggtagattgtgagaatgaaccacataatgaagaggggatgtgtagcacatgtgagttttcccatcttgctggtttccttccctggaagaggcaaagagaggacaaggagctggctgttactatttgcttgcagacttggtgtgtgctttcaaattggaagctcctgctctgacacccagttcttttttgttttaagttgtactttagaagagaaaaaaattcatcaacacccttttttttaaaagatggaaaatgggttaagaaagtagcacgaggaactgtgagcccaacataattagtgtgatgaaagagaagttagccatttctgtatgtaacttttgattaatgatattcagctctaattaattatgtccaattctaattaatgacattagtgtgcaagctggcattctcaaactatattctgaggattcccagcggatgttcttgaatataatagtccccggtcacattaggttgggaagtgctgtgtgtactgcccgtcttggacactcccaaagcaccatataaaaggccttcagaagtcctgcaagaaaaggaacaatttaaatttcttttaacctgtcatttcccagacttacttttaccatgtgtgctgctaggcacatacggacatgctaatttaactctcataccacaaggtgtgcttggatgaattgatgagcaatgtacatgtcatggagacgttttctaagtcttccagagtcatagcaggggtctcctgtatcgcagcagagcatactgcaaagaattgcatttccatacagtctagggctgctgtgaactaatctcctttcttgggcaaatcgcttaatctccttcaatcagttcatacatctgcagaggaaagggtgatggcatgccaccctggatggtgggaggactcctagcagtggtggctgttaccatctcataagaaaccctcattacaagaaagtccacgtcatttgccatgtgctggtctcggggggtcagcgagtggggggctgcagggagagaccaccagttacctcctgagcctcacgtgtggggtacactgtgttttgtccgttgttggatttgtattcattgttcatctaaaagtgattatgttgaaaaacagaatggtggcagacaggcatgtttggcatgggttaatgcgaggctggaaagagagcccctgaccttcagttcgagaatcagccactgcaggaaagggtggcgtcttggtggccgcatactgtgaatgtcaagggagacgaagagtgcaccctggggagggcggactcatcagtccagtgggttgtccaggagggagtgagggttgatctttcatctcgaaggatgaatatacatttctgcgagagagggggaagacgggcgttccaggcaaacaagcgtgtatatataactgaagcgtggacagaggaagcagcgtggctggtctgggaatggaattgtttgatctggcttgatggaggagctagggggtgaggtagaagaggtggcagaggccagcttgacctgtgtagatggcttgggagaagccctggcaggtctttgttggagggctgacaggaagggatatgtgctttccatagttgaccttggagggtgcggcatggggtggaggcccgtgcaccagaggctcctcatagagtctctacagagagatgaccaggctagcgttttcatggcatgaaggttgtcttcagaaactcgcttcacaatctacttaagatgagtcaaatctaccctccaaagaacatctgctgctactggagatagcgcttcaaaagctaatgcaggtgctgaatgtttttccaccatgagggttccttctgtgcatcaattagtctagactcttgctgtttgaggaaagaggctcagagtagttaagccactagctccaggtctcatagctggctgataggacatcaacctgcggagtctctatggaggtggaatagtttcagtggtgcactgaaacagtaggggatggataggagaaaggcttggtctattagtcaggttgagccagagaagcagtaagggatggatatgaggagatacattgtgaggaatctgcacacgtggttttgggacctggccaggcaagcctgaagcccgcagggcaggccatggggaagggcaggctggaactcccaggcatggctgcagctgcagtccacaggcagaatttcttcttcctgaaggaagccttggctctacttttaaggtctcctgacaaattgatccagacccagacagattgtctgggatgatctcctttctaaaagtcaactcattatggactttaatgacatggacagaagactttcacagcaacgtctggaagagtggctgattgcctagccaagtcagtacctcaaaaagaccacactcttgataacacgtgggggctccaggaccaaaagctggtgctgcagatgtgtggggtggcagcattgtcacttcctgtctcccactaacctcagggtcacagtgggctggtggctgtagcatgctccacacctgctctcagggatgctggagggagactgaggcccaggcttttgtcttagagacttgggatatgtctaggatcccttctaaaagccaagttctagatagaatctggcctttcagggttggagagaccccatgtggcttctgagcagacttccttcctgatctcagtcttggaagtgaaggtcttacccctggttgcccccttcctgtgacagagggctctttgcctctttgcactccatgccccagagacaatcagtgctggggacaattttgtcagaaatctattcccagccctagcttagcctagtggcactctcagtcctgaaagctagaggccatttccacattggtgtagcaccgtggttctcagactgtgtttgctatcaggatcacctggggaacttggtaaaaatacaaatgcaggtcatattctgcttcctccatcctgggcctctgtgttctttattagccttcttggtggttctgacctacatcaaagttgaggaccactggcataacgcacggctgctcgaactccagtgtgcgccggaatctcctggggatctcatttattttatttttattttttgagacggagaatcactcttgttgcccaggctggagtgcagtggcacgatctctgctcaccgtaccctccgcctcctgggttcaagcaattctcctgcctcagcctcccgagtagctgggattataggcacatgccaccacgcctgactaatttttgtatttttagtagagatggcgtttctccatgttggccaggctggtctcaaactcctgatctcaggtgatccacccgccttgggctctcaaagtgctggggttacaggcgtgagccatcacgcccggccagggaccttgtttaaatgcagattctgattccatggtttttggtggatcctgcgattttgtgtttctaacaaccccccaggtggtgcagttgcttctggtcctcaggccacatcttaaatagcaaaggcgtagataggggccgaaattaagcacttaagaattacccagacttgcatcggaattctgcctctaccacttaactgtctctgtgttaccctgagcagactgcttgatctctctaagccttgatttccttatctggacaatgggaataatgtgcctttttttttgtttttttgaggtagcacctctgtctgttgcctagcgtggagtgcagtgctgcaatctcagctcactgcagcctcaacctcctgggctcaagcggtcctcccaccttggtctcccgagtagctgggacctcaggcacacaccaccacacccagctaatttttaaatttttaattagagacagggtctcattgtgttgcccagactggtcttaaactcctgagctcgggcagtcctccctccttggcctccgaaagtgctgggattacaggcgtgagtcactgctcttgctgctttttaaataaaaactgctggccgggtgcagtggctcacgccagcaaattccagtgctttgggaggccaaggcaggtggatcacttgaggtcaggagttcaagaccatcctggccaacatggtgcaaccccatctctactaaaaatacaaaaattgcctgtcgtggtggcagacccctgtaatcccagctactcaggaggctgaggcaggagaatcacttaaacccaggaggcagaggttgcagtgagccgagatcatgccactgcactccaacctgggcaacagagcgagactctgtctcaaaataaataaataaataaataaataaatattgctttgacagttagaaaagaaagagtttaataccgcaacataataaagaccatacaggcaaagccaccagccaacagcatacccagtggtgaaaaattgcaaaggcttttcctcttaagatcagaaacaagacaaggatgccccctttcaccacttctatttaacatagtactagaaattctagccagaacaatttggcaagaaaaagaaatcagaggcatccaaattggaaaggaagaggtgaaattttctctcttttcacatgtcatggtcttatgcaatatgtagaaggccttaaagacttcacacgaaacacacaaagctgttataactaatacatgaattcagtaaagttgcaggatccaaaatcaacacacaaatatcagttgcatttctatacactaacagtgagcaatctggaaggggagttaagaaaaaaattccattaaccaaggaagcaaaaaaattgtacacagaaaactaccgaacattgctgagagaaattaaagaagacaccagtaaatggaaagacatggaatgtttttagattagaagacaatattgttaagatgtcaatactacctatattagtccattctcatgctgctaatacagacatactcgagactgggtaatttacaaaggaaagaggtttaatggactcacagttccacatggctggggaggcctgacaatcatggttgaagatgaaggaagagcaaagtcatgttttacatggcagcaggcaagagagcttgtgcaggggaactctcatttataaaaccatcagatctcatgagatttattcactaccacaagaacagtgtgggggaaccacccccatgatacagttatcgctacctggccccacccttgacgtgaggattattgcagttgagggcaagatttggcgtgggacatagccaaactatgtcatatccaaagcaatctacagattcattgcaatccctatcaaaatcccaatgatgctttttgtagaaataggaaaattcgtcctaaaattcttgtgcaatctcaagggaccctgaatagtaatagcaatcttaaaaagaaggacaaagttggcgatctcacacttcctaatttcaaaactagctacaaagctgtagtcatcaaaacaatgtagtagttgcataaagacagacatacagacgaaaggaattgagtagacagcccccaagtaaaccctgacatatatgggcaaatgattttttgacaaggatttcaaggtcattcagtggggaaaggatagtttcttcaaatggtgttggaaaaactgaaaacaatataaaaacaacacaagagaatacaaaaatcaactcaaaatagatcaaagacctgaacataagagctgagaccataaaactcagaagaaaacaggtgcacaacttcatgacattggatttggtagtgacttcttggatgtgacaccaaaggcacaggcagcaacaggaaaagataggtaagttggacttcatctaatataaaaacttcctcaaaggacacagtcagcagtgaaaaggcaacccaaggaatggacggaaatctttgtaattcatacatctgataaagggttaatagccagaatgtgtgaagaattcttagaatttaacataaaaagaagccacctgattaacaaacgaacaaagggcttgaataaacatttctccacagaagatagacacatggccagtaaacacagaaaaacatgctcagcatcacaaatcgttagagaattgcaagtcgaaatcacaagataccacctcatatctattaggccggctattacaaaacaaaacaaaacagaaaataagtgtctgtgaggatgtggcagaattggaacccttgtgcactttaggtgggaatgtaaatggtgcagcccgtcggaaaacagtatgacagttcctcaaaaaattgaaaatagaattgccgtggaatctaggcgtggtttcacttctgggcatatgcccaagggaagtaaaagcaggggctcaaggaaatatctgtacattcatgttcatgcagcatgattcacaatagtcaaggggtggaagcaacccaggagtccattggcagatgaatggatcaacaaaatgtggtgtatacatagaatggaatattattttgccttgaaaaggaaggaaattctgacacatgctataacatggatgaaccttgaaccttgaggtcattatgctaaatgaaggaagccagatagaatagcacagatcctgtgtggttccactgacatgaggtactcagaatagtcaaattcatggagacagaaagtagaatggtggttgccaggggctagaaggagagggaagggggttagtgtttaattaggacagaggttcagttttacaaagtgaaaagagttctggagatggatggtcatgatggtagcacagcagtgtgaatgtacttagtgtcactaagctgtattcttaaaaaggcttccaatggtaaatttatgttacgtgtattttaccacaatttttttttcttacaacggaaaggactcaacaccatatctagtaaaacacacactgaatgttgttattgaaagcatagatggcaggatcacttgagtccaggagttcgagaccagcctgggcaacactgggagactcccatctctacatagaattaaaataacagattagctaggtgtcctagctactcaggaggctgaagtgggagggtcctttgagcctggaagttcgaggctgcagtgagctgtgatcatatcactgcattccagcctaggtaacagagcgagatcccatctcagaacaacaacaaaaaacaaataaaaaaataaaagcacagagccagtcacagggacactccatacatatgaattctacccacagtcattcgtgcccctgagtgtctgccttcccaccattctctgggagttggtttccattccctcacctctcctgttctctctgacaaaggtaattgaaactatgtttctgttctttcagtatggccaggtgggaagctgttctctagtgtgagttaaccaggacagagggtgtgtatgtgcaggggagagaagccggcaggctcttcctcccagatgctggactatggaatgtgatactaacatggggatcctccccaagagccttggatcccctagtgcaccaaagtatcctactgagaaggcatcagaaaatctgactcacagaagttagggcagtgtttacagtaccatgacagcaggcagagcttggggttcaaagcagaatctgaggaaagactctaaaaagacgagcccctgcccaagatatggtgccttttctagtctcatagcacattgcaccccctcccctcactgtaacaatccacaccctcagaacgcgcacctggagttgttcatggagactaaagtgggaggaagctttggacagtcacctttttgaagtctgttttgaattgaacagtgtgcaaatgataagccacttattttaaaataagcttcttaattcaagtgtaatataaacagaaaagtacaaaaatcctaagtgtttattaccatgaatattttcaaagtgaacacatccatgaaactaccatccagactaggaaacaaaacatcaccacaacccaagaatctcccctagggtcctctcccagccataacccacccccgaccactaccaccaccacctaaaggtaatcagaatcctagcaccaaatgttatttttgcaaatgtttgaatttttttttaaataaatgaatttctacaatatatactgttttatgtcagcttattttatgcaacattatgtttgtgagagtcactcacaggtggtgtgacagtagttcattgactcactgttacagagcattgtaaaaatacaaataattcatccattctatgtttgatggacatttgcatcttttctagttttgggtcatgattgctgctgggaacactgttacacatttgttgtacacatgattgcatttctattgagggtacatccaggattggaatgggtaggtcacagggtctgggtatgtttctattttagtgaacactgccagtcctttttctgacgtgattgtacccaattacactcccacctgcaaataggagtttcatttgctccacatccttgctcataactggtggtgttagtcattttaatttgatttttagtggatgcatggtgggatcctctggtatgattttcagttcactgaagactgttgaatatctctttcgaatacttgtcttgtgcttttcgaaaccttctcttgaagtttttgtgcaagtttttgctcatttttctgttgcattttctttcttagtgctttgtaggagttctttttttgttttatgagatggagtctcgctctgtcgcccaggcttgagtgcagtggtgcgatctcagctcactgtaagcttcgcctcgtgggttcacgcccttctcctgcctcagcctcccaagtaggtaggactacaggcgcccgccaccagcccggctaattttttgtattttttagtagagacggggtttcaccgtgttagccaggatagtctcgatctcctgacctcgtgatccgcccaactcggcctcccaaagtgctgggattacaggtgcgagccaccacacccggccgggagttctttatatagttagtacctgagacctttgctagatgtacatattacaaatattttctcacactttctcacgttcagtggtatcttttgatgagaaggcccagattatcaatcttttcctttaaggttaatgctttttgtgccctgtttaggaaatctatgcatacctaagaacatgaaaacaacagcatatttattttttccagccattcttgttttctaatatatgattttagggttataaatagcctattaagcctgctttagctgtaatccactatttttaaaaattgtagtaaaaaaacacagcataaaatttaccatcttaaccatttttaagtgtacagttcggtagtgttaagtaaattcataatgttgtgaagcagatctctagaactttttcatcttgcgaatctgaacatctatacccattaaacagcaacttctcattctccttgccccagcctctgggagccaccattctactttccgactactctaggtacctcaagtggaatcctacagtttctgtctttttgtgactggcttattttgcttagtacagtgtcctcaaggttcatctgtgctgggttgtgtgataagattttctccctttttaaggctgaataatattatgtggtatgaatagaccacattttgtttatccatcatccatcgatagacattgggttgcttttattccttggccatgatgaatagtgctgctgtgaacatggctggctgtccagcaccatttttggatacgttgtatttttattattaattagttcaaaatctgttcactttttaaaatttctcctttgaaatgtgggttattttaaagtagttgatttccaaatgcctccatattttctggttatatttttgttatttatttctagcttgcttaccccgtagtcaggaacagattatttacaatgttaacattttgaaatttgtttacactggctttagacttgtccaccatatgattaattttgacagactatcccatgtgcccttgtgtgtagttcctcagttcagtactttcgatatattcatgaggaaaaatgggtaattgtggtgttcaaatcttatatttccattcttatttttacttctttgttatatcatttactgaaagaagtgtgttaaattatccagctgctcataatgtctgtgtctaatagacataaatttcataatgtctaatactttagatttgtcttattatagtcctgtcaattctccctttataaattttgagtgcatttaactagatacatataaatttagaatttattcctagtaggttgccctttttaattatgaattctttcttttccataagaatgctgcttttcgtaaaatctagtttgtctaattaccaatataggtatataaactttcttttttaacttactgctttagaatagttttagattcacagagatgttgcgaagatagtagagagttcccatacatcctgtacctacttttccctgttgttaacatctcacattagtatggtacatttgttacaattaatgaaccagtgccaatgcattattattaactgaagtccatacttcattcacattttcttagtttttatcaaatgtccttttgctgttccaggattctattaggagactgctttgagttcagttattatgtcgctttaggttcttttagactgtgacagttcctctgactttccttgtttctgatgaccttgacaattttgaagagtagtggtcaggtattctatagaatatctttaaatttgagtgtgcttggcatttttctcatggttcaataggggctatgggctttggggcagaagatcccatctgaaaaagtgccattcttatcctatcaaatcagggctacataatttatcactgctgatgttaccctcaatcgtctgagtgttatgcaccatctccatgagggaacagtatctacacaaattatttgcaattctgcacagggagattggtctgttctcactcatttattttctcattcatttatttatatttgtatggactcatggatattcattgtatactttgggctataaaccagtattgcattattaattttgttgttcagatagttccagcttttgccctttcctaagatagtggactcacccctctgtgtttcaactctaccaatttggaccctcaagttcttgttgccttattagccataaattgcaatttcttatttccccagtcctctgagactactgaaagttctgcttaggcctattgcctcttaaccactactttcttcctgtgtgtgtttttaaccttttggcttccatcactcacaaatccccaaatgccttgacgagaaaagcagcacagaatgctgagcttatttctgggtaattatctacttgtcatgatctcagcccctcaagtcctagctgccttggactctctgatgcttccacagagatcatttaaaaaaatttcgtcaagagtttctagttgttcttggtgagaggattagtctgacacaagctagtgcatcatagcaggcggtggaattcttcagacataatatttttttttacttcttctactatgtcatagttgatggtgcctcatggtattttaatatctgatgctttgcacccatacagcaactatcctgagtaacgaagatgttatgtcatataggaaaatgagtcattcttttttttttttttttttttttttgagacagagtcttgctctttcgcccaggccggactgcagtggcatgatctcggcttgctgcgagctccgcctcacgggttcacgccattctcctgcctcagcctcccaagtagctgggactacaggcgcccgccaccgcgcctggccaattttttgtattttttaagtagagacggggtttcaccgtgttagccaagatggtcttgatgtcctgacctcgtgatccacccacctcggcctcccaaagtgctgggattacaggcgtgagccaccgcccccggccgaaaatgagtcattctttgcatttcattcatttatgcccttagtcacaagggctttagcaaagaattggcttccaccctctctttaaggtaaggaaataaataatgaccttggaagacagtattcatcataaaagcgcttgatgaaaggagcaattggagtgaactatgtaaaacaggcttttcagtctaatgggacagtgtaattactggtgcagatttctagttaggccttaaagaaattaagcctccctatatggttaataatggacttgtgtaagaagattgcttcagagatgaagtttgtgattcacattagcatatttggcagtgaaagcgttacctttctcaatcaagcaggatatgtaagatctttgtgtatgcttttgctaaactttactgctgccatccctgaacttgacttgatatttttacatccccttcaagtctgcatcccagttttgtgtcatctacagttctgaagagctgccttgtgctttatcatcatccagggttgaaaagagccagatcattggagaatccccacagactgacagttttccctgaatcgatgcctgcttattgtgctcatgcaggtagctcctattccatctcacttcgctgcatgcagctcacatatttcagatgatccacaagaacattgggaaggacctgccaaaatcctgccttgctaaagtccaggtatactctcttccagatctcccttaactgcctttgcagattctatatcggagaaagaagtgaggctaatttcacaaacttattcttaccgaattcatttatagctctaataattaccacttttcttagatgtgatcccaaaacaatcctttaataaatgcattttagaactgcactgtccatagtggcagctacttgccatttaaatttaatttaaatgaattaaaatgaagcagacaaaaaatgcagtttctctattggactaaccatgtttcaagtgttcaatacctgccatattgggcagtgcagatagaacacttctatcattgcagaaatttctgttgaacagagctgttctaaaaccttgttttagaatcagatctgagctcacccgtctgcagattactcagtcatcatttgactgtttttttttttttttttttaaagagacagggtctcactttgttatccaggctggagtgcagtggtgccatcatagctcactgcagccttggactcctgagctcaagtgatcctcctgcctgtctcctgagtagctgggcctacaggtacatggcaccaggcctggacattatttaagtctttaagaaacatctacatgtgttttttcctgtcacctctctttttctccatttccttcaaaatcaccttgaaggcgactccatttctgtattgcccaaatcagtctacagtgtaggtgttggatgtggactttttttttggtttctaatgaggttgtgttgcagatgagctgaagccacctttgatattctaggatttgtgcctgaagaatagcgctttctgtcttgctgatgtttatatgactgctatgattgtcaagggaaataaggagaaatgaatgggatccacgttgcttggcccagcatacctgtttctgagtgctgttggagctgagaggcatgctcttggagaatcagccatcaagctgtcttttccagagtggatgttgtccagggcagttgcagagtgagcacactgtcaatgagtgcctggggtccttcatttatttctttacagcatctgtagtagaataaaattccagtgttaagagacaaaaaaaatgtgcccagctctcctggggttgacagtctcagttggtaaatcccatcccaagggggcagctcctctcctgtctgtggtttgcctgctgtcccccaggagccacactcaccagtttggtcagctggcagatgataagagggagagaatcttttagaaaacagatcctggagatcattgttagtggagaacttattatcaagtcaggaagaagaaaaatcattgttagttgagtgaatacattttaaaaaatgataaagtgttcgtcaggcacttgggatttcttgctcatatgctaataggatttttgaaaatccactcactgtttggaaacttgcttgctcagtgacaactgcatccaaatagcagatcatgagccaggtttgtggggggacaagagtgaagggagttcggaggaagtcgctctgggccaggaggcagggaccctggccaccagccatgtgacccggggcagatccttgcagtgctgggccttggttttggccactgccccctggccccccacttcccagaattattgtgaggaactgtgcgtgtatgtgcaggaactgggttaacatatctacttatggttggccgggcgcggtggctcacgcttgtaatcccagcactttgggaggccaaggcgggcggatcacaaggtcaagagatcgagaccatcctggccaacatggtgaaaccctgtctctactacaaacacaaaaattagctgggcattgtggcgcatgcctgtgatcccagctacttgggaggctgagacaggagaatcacatgaaccagggagtcgaaggttgcagtgagctgatatggcgccactgcactccagcctggagacagagtgagactcagtctcaaaaaacaaacaaacaagcagacaaacaaacatatctacctctggtcaacacagaaacaaggtaagcttttgttatcccctttgatagacaaagcaacagagcttaatgagcatgcatgtcacaaggaagcacaaattcacgcttattatttttatgggaagacccctcacttcctggtcctgatgttctctgtgggacctttggtgagtcagggaaggcctcacagtatggagacaacagtcccagcctctgacttgcaggagtgtggggactaagtgacactggaagtgtgctgcacacgtgcaggcctggattattaggagggaaggttagaaatcaagagccaggggaaaactgggaatagctggctggcttttcagaagggagtcattattttgtgcaccttgcaactcaggcagtgagcctggcggggaaagagaaatggctgctctttttttctgtccatgtgtcaccccctgtcagtgtgttactgggtgcaggtgtctcctctgatggtgtctgggcttttctttcccctcccttccttctttgcctgcttctcctttgctcctctgtctccgtttctctctccctgcattttgtctctttctattccttctttcttccttttttatcttcagattttaacctgttcctttcatcaaatgatgcttattaaatacatttggtgatttatatttttgtttctaagaaagctgatcaaaataactgtgtaagttcagtccgtgaaaagacaataatgatgacaggcaggcagcgctttggaggaaggagggttgggtcccgggtacccctgattcggtgggtgtttgtgcatagagtggtacctgcctgcttgaggataggaggctttgcagcttgaggtccttgctccctggtgtggggcatctgaagggctgtggtgggaagagggtcagaaccaaggccagatgcacccggagcttgctgcacgcacttctgggaggtttcctcttattttctctattttaatttctccattttctcttttctctctttcctctctttctggaattcccatctatctgatttttgacctattcattctatctttgaagtctctcttttctttcatatttttccatcttcttttctttctttctttttttttttttttttttttgagatggaatctctctctgttgcccactgcaacctccacctcctaggttcaagcaattctcctgcctcagcgtccagagtagctgggattacaggagcccgccactgcgcccggctaatttttgtgtttttagtagagacagcaatttcaccatgttggccaggctggtcttgaactcctgacctcaagtgatccgtccaccctggcctcccaaagtgctgggattacaggcatgcgccaatgtgcccggcaccatcttcttttctttccgttctgttttctgggatagttcaacgactttaaatacccatattgaaatgtttatgcttgctcttactttggctctctgagggctctttctattctttcgtcatttcttattttgtagcactgtatctttgtgtttctgcggcaatatcttcttctatttatttaaaggtattaatttgttattttgtttcttttttgacaattacttctgtttccttcactatcttttttcctttgctgtccttgtacttgcttgcctggattttcttcttcctgtttgagaccttcctcccagatctgtgagccgtggttgttaattcgcattgagaagtgaagcactgaaaattgactggagtgtctgcaacgtggctgcacattagcatcacctggaagcattaaaaactacctctcccgggggacagtctcagggccattggatgaagatctgttagattggggtctgcatattgataggttgataaataaagatattgatagagatcggtaggtagaaatacagattttccctcctcagcaattctaatgtgcaagcagggctgagcgttgtatagtcttgggtgacagtgccgggcctctggagagttggtataattaccgtgcagcgaaaccactctgcgttttactgtgccgggtgcctggaagactttgattgcatccatatgattctttttctgtacctctggcaaattgcagattgggaggaattatatatccctacagagacttcagtgaatgaagtttcagggacctatgagcaagaaggatgaactggcttcccggggaggggccagcagtccttctgccagacaagtcatcagggctgggacaggaagcatgggaagggcagctgtgcagagcaggatccaggaggggccacctggtggcaggtgtggccactgagcagcccctggctagggatggagctggagctgccagggaagctttgaggccaggtaacttggctcttgggctctcatgaagccaactgttcctctcccaagctctgagaaaacagtggagtcctggagtgacaggatatggtagctccataaggaggaggaacctgtagttggaggggcaacaccaggaggccagtgagcgatactctgtacctgagagaggtggccggaacctgggcccccacttgctgccagtgaccttgcacctgccacaccttctcttggagttttggcttctttaactgggacatgaggatcctgaccatctctgccaagcaggagaggaaatgggctgatgtgtgttgtgaggcagtagagactggggcataggaagcaaattgactctcagagtttatggtataaccttctcccacgctgtagggatcaggtttgcccctaaacctgcagactggctaaggccagggctggaaagggaaaaaagtaagcagaggacaggtcatgctgcaggccggcccctcacccctggtgacttgtgctcttggagtgagggcccaggagggggttgcctgcctatgcgtgtctctccctttccccctcctgttctgtggggctgggcctcacacggccattcttcgaaggaggaaggtggccttttgcattccctgttggtgtgttacttattgtcacttatttttgattaaggatattatatttagggagaaattatttgcattttctttgtaaatcatctgaagaattgtgcaacacaggagtgcattcgggaagaaaattcagacatcagagataaagcagagttctcccttggctgcatctacaaccttcctctccctagagaaccactctgtggttagtgtgttttccttcattatcttatataagcatttatgcatgtgtagatgtagatggctgtgttttgtttttatgcacatagaaggtatctgtgcattgttctgctgccggagttgttcagaacatggtattgtggagaaccacatgactgtacacacaggtctatcttagagacctgcctcatttgctttaactgctgcagaggcttccagggaccgtgtgtacagtactagatactgtttaatgaacactttcctactgatgaacatttaggttgtttcctaatgtttgctgtcacaaacagtgatgctggtgggttaatgcttctctaggggagagagcaagaagcagaagtgctggctgtcatctgcattctgcagtttaccagatactgtcaggttcccttcccaaatggctacagagtggtttggtccctgcagtgtcatcagttcccgacattataactttgcagatgtgatagggagaaaatctccattttattttttcatttcctggattatttgtgaagtcaagtatatttgcctgtgtttactggcacatgtattttctctttggtcaatttcccttttgtaatttttgctcagtttcccatggggttattcgtctttttcttattgatatctaggaaggtcacacgttcatgtgagtgtttgggtgtgtgggtatacaagcaaaaaaaggtttaatacatcctggatgctcattctttgatacatttacttcgactattttcttccagtctgttgtcttctgttttaggtgttttttttttttctcatccaggtttaaacattgtttattgttgtagctaaataattcactttatttagggattataagaaaatgtagaaagtaaatttgcattcttttcctttttcttagtattatgaaacttatttcttttttaaaaaaccagtctgttgaggtaagattgccatataaaagctgtacacattttttttttccagtgacttttttaaaaaatatatttaaaaacaaaaccggccgggtgctgtggctcacgcccgtaatcccagcactttgagaggccgagaggggtggatcacctgaggtcaggagtttgagaccagcctgaccaacatggtgaaacccggtctctactaaaaatacaaaaaaaaattagctgggtgtggtggcatgtacctgtaatcccagctactcgggaggctggggcaggagaattgcttgaacccgggaggcagaggttgcaatgagctgagatcatgccattgcactccagcctgggcaacaagagtgagactccatctcaaaaaacaaaagacaaaacgacctcctcccaaataacccccaaacaaacaaaaaaccagattaaataaaatttacagtgaatatacccagcaaacatttgtatgtgcaattcaatactgtgtctgttactgcggcacgaacctcagacaatatataagcgttctggggggtcgggagagtcccaagttttaactctgtggggtctaggaagacaagatggggaagtgagagaatggggaaatccgttttgtttatcttaattctttccatataaatatattcataaagaccaaaaaggaaaggaagcttgggatgttaaggtaataggagaataggagagtgtgggactttcccaattctgactgaccaaaaaatatgaaaggaattaattttatggtgggagaagagatttaaaaaataaaaaaaagaggatgggggccaggcacagtggctcatgcctgtaatcccagcactttgggaagccaaggcgggcggatcacctgaggtcaggagttgagaccagcctggccaacatggtgaaaccccgtctctactaaaaatacaaaaattagctgggcatggtggcgcgcgcctgtagtgccagctactcgggaggctgaggcaggagaatcacttgaacccaggagccacaggttgcagtgagccaagatcatgccactgcactccaaaaagctgtacatatttaatgtacaactttgtgagtttagagcgaagccaacccccatgaaaccattgccacagcgtgtgccgtaaacagatccatcacctgctcacgtttcctcctgcctactttattacgatgatgatgatttgtgatgagaaactcaacagaagatccaccttctcagcagatttttaactgtacaatacagtgttgttagctgtaggcactgtgctttatagtaaatctccagaacttactcagctcggacagctgataccgtgtaccctcggcccagcatctttccacttcccctacccccagctcctggaaacccccattctactctctgcttctatgagttgactttttaagattctgaatataagtgagatcatgcggtatttatctttctgtgcctggcctatttcacttaatgtcctccagtttcatccgtgtggctgtacatggcaggatttccttctttttaaaagccgaataacactccattgtaagtgtataccatgttttctttatctgttcatccctcaaaggacatttagattattcacatatcttgggtattgtgaataatgccgcagtgagcgtgggagtgcagacttctctctgaaataccgatttcagttcctttggatgtatgcccagcagtaggattgctggatcattcggaagttctatttttaattttttgaggaacctccatactattttccataatagtgataccaatttgtattcctatcaacagtgcacaaggattttcttttctgcacattctcaccaacgcttcttatctttcatccttttgatactagccattcttacaggtaatagtgtgttttgcatttccccgattggtcttttccttgatgattttttattgtcttatttaagaagggcttccttatactgagtatctaacattttagagtcacctattttacaataagtctttagtccccttgaaatttatttttgtgaatagcgtaactcagggatatatatatagcttttaaaaaatgagttgcaaagtttataacccattccccccaccagctgatttgacatgttacctttatcatatggtaaatcattatagatgatgagttgttctggactgtcttctgctggtctatttgtatactctcgtggaataaaaaattctatggttttatatccttcattgttcttctagagtgtttctgcaattgtttcctctgccatctgaattttattattctcattggaggttcttttggaattgcactgactttctaagttgatttggaccaaattaaaatacttaaaattgaaatatttactatattaaaatgcagtattatttgtttttatctgggaatgtagtgtatttttttcttgaaagttttgtacacttttgttatgttctttccctatatgctttatagttttgttgctattgtgtatgaaatattttttattattacattttctatttggttgttgctggtgcttaggagagccattgatttatgtgttaaactcatacctggccaccttgctaaacctttttcttagtcctaataattcgtccgttgattctcttggttttctataaagacaggaatattgtctgaaaaaaatgcctccttcttcccctcttccttctcaaactgtacacctcttgagatgtctctttgtgtttgtacttctaggtagggtaaccagccccagactgaaaggtgacagtgatagcagccttcctaatcttgtccctaaatttacaggggatacttttatggcgtcactataaaatgagatgttttgctgcacttggctgataaatatcctttatcaagttaagggagtttgcttcttggtctaccttttaaggtttattttaaatcaggaatgggttgtcgaatttgatggccattatacctttttccttttttttttttttttttttttttttttttttgagacagagtcttgctctgttgcctaggctggagtgtagtggcgcgatcttggctcactgcaacctctgtctccgaggttcaagcgattctcctgcctcagcctcccgagtaactgtgaatacaggcgtccgcccccatgcttgactaatttttgtatttttagtagagatggagttttgccatgttggccaggctggtcttgaactcctgacctcaagtgatccacctgcctcagcctcccaaagtgctgggattataggcatgagccaccacacttggccccattttatacctttttcatggaagtaaacattttctaattcacaataaaagagaaaaaagtataataaacacaacatatccattgccatatttgcttagatttgttgttagcattttattatatttgctacttctttcctttttgtcgattttttttttttttttgagatacagtctcgctctgttgcccaggctggagtacagtggcatgatctcggctcactgcaacctccacctcccaagttcaagcgattcttctgcctcagcctcctgagtagctgggattacaggtgcatgccaccatgcctggctaatttttgtatttttagtagagacggggtttcaccatgttagccaggctggtctcgaactgctgacctcaagtgacccacccacctcagcctcccaaagtgctagaattataggcacaagccactgtgcccggccttttttgctgaagttttaaaagttgtagccatcattatttggccatataagttcagcgtgcactttaaaaataagcacatcttcctacatttccacgagaccattatcatagtaacagcattcacagtaattcattgataacatttaatacccagtctatggtaaacactctccagttgttaccagaatgtcctctacagctggtttctttaccagggcctggtcactgcggagacagcactgtgggccctgatgtctccactccttctctaactggaatgcaccctcttcctttttgttccattacacctctctattgcagagactcacgtggaccagctgtcctgcatcaaatcccatcttcagcgttcgtctgattgctttctgggctagcatttaacttttctctctagctcttgcgcttcttgtaaatgggaatttcagtccaaaggcttgtgtgtttttgctgtgaaacaacagcagaatctcataggacgagaatttttcttcctgtttgtaggcagggtcagcaaaagggcaggtttgttcaggttgcaggtctgctggggtagctctgcctgacatgtttattctgagacccaaactagagggtaggggctgcatggggctcgtgttgcccatggtgagtcagaggaacacaggaggagcggatggaagcaggagatggcctgaggtatagccttggggcttgcaggtggacggttcccattccactgtcgagtatcaatggagtgggcagtgtgcttgtcccatggaggaggaaggggtatttgctgaatgattaaatccaacccaccaaagcatgtttagattcagactaaaagttcttggcaagaatacttcataagcggtggtgtatgcattctattgcagcatgtcacaattcacatgtaatacgtggttgtctcattagcaactgatctgactagttaccatttattaataagatgctgtgctgaacttctgttaacctcaaaaggggaaagcaccaggttcaaggctgaagaagagacccagagccaggaaacaagaattgggattttttttttttttttttttgagatggaatcttgttctgtcgcccaggctggcatgcagtggcgccatcttagctcactgcagtctccgccacctgggttcaagcaattttcctgtctcagcctcctgagcagctgggactacaggcacgtgccaccctgcccagctaatttttttgtaatttttagtagagacaggttttcaccgtgttagccaggatggtctcgattcgatctcttgaccttgtgatccgcctgcctcggcctcccagagtgctgggattacaggcgtgaggcactgcgcctggccaagacttgggattttattaggggcctgcatacaggggagacggatggtggtggattggaccagagaaccgccttatgtacagagatggtccagtgatgggctgggcgtggtggctcacgcctataatcccagcaatttgcgaggccgaggcgggcagatcacctgaggtcaggagttcgaggccaggctggccaccgtggtgaaaccccatctctgcaaaaatacaaaaattagccaggcgtggtggtgggtgcctgtaatcccagctactcgggaggctgaggcaggagaattgcttgaacccgggaggcagaggttgcagtgagccaagatcgtgccactgcactccagcctgggcgacagagcaagactccgactcaaaaaaaaaaaaaaagaaaagaaatggcccagagatggcgggctggataacatatcggccttcctgcagtcttgtggcagtgggctgggcaggaaagctgcaacttcttgccaactttatgcagtttatttagcatttctacttaacaccctcctcttaatgacccctacccagcaaccttcatttaccccaaaactcagggcctcaatgccctgtatggcccgtgttccataggatgttccaggggctcaaatgttcctcatagacaaggaacgaatctctgggttggccacacctgattccccagctcagagcacacactcaggtgcatctgccatacagggtccttctgagggtaggttcaagttatcgctgtcaggtgcatttaccctacagctggtgacagcttgagtcttcttttataaagtttcttatgcttgagactgacaagaaatctgtggctagttctttggcaccatgtatatgaacggccagttaaccctctgttatccattggtgatcctggcctgaatcagttaattcattagttgttgcaaattggtggtttcacaattctctcatactgttttcatttattagctgttattcttctgtaaagaagagattttccttatcacctggagctgttagaccaccctgaaatacagtatcgttagaacaggccgggcatggtggctcacgcctgtaatcccagcactttgggaggctgaggtgagcggatcacgaggtcaggagatcaagaccatcctatctaacaaggtgaaaccccgtctctactgaaaatacagaaaaaaaaaaaattagctgggcatggtgttgggcgcccatactcccagctactcatgaggctgaggcaggagaatggtgtgaagccaggaggcggagcttgcagtgagccgagatcctgccactgcactccagcctgggcgacagagcaagactctgtctcaaaaaaacaagaacaaaaaaaaccaaatccttatttctcttcaattgttaattttcagaataagaagttggcaatagccaattttaatggtatgatacattctcagggtgtgccatcttcccctttatgatataaaccatttttggtcatgacgtgttagtttttaatgctaatagtgaacctatttgttaaagtttgaggtaagatctttgcctctctcatgttggagactagtttgtgcttatcctttcataaaataaattgcttcagctttccatctcttttttgagatgtgacatcatggtaatctattccttgaaaatgtaataaaacgtgtttgtcaattcatctcggtctggcctttattaggttaccttgttattttaaaatatcttctatagctattcagtttttctacttattgagccaattgtggtaatttatattttcttagaaaatcttacatttcattcagttagatttgcaaattcattggcataaagttctgaaaagtattctcataattttataaatttttctgcatctgtaattatgggcttttcagttctaatgtttgtgttttctttctttttcttgatttgtcttatgatatgtattctttttatactgggccaactttcaattaattactgtcttaattttttttagtcttttatcttttttttctttttttttctttttgaggcagtcttgctctgttgcccaggctggagtgcagtggtgtgatctcagctcactgcagcctccgcctcccgggttcccgcattctcctgcctcagcccaccgagtagctgggactacaggcgcctgccaccacgcctggctaattttttgtatttttcgtagagatggggtttcaccgtgttagccaggatggtctcgatctcctgacctcatgatccgcccaccttgaagcctcccaaagtgctgggattacaggcgtgagccaccgtgcccggcctagtcttatatttttctaattccttcattttgattttcacttttatttcttagacttattttatacattaacactcttttcgtttttttttttaatttaatttttaagttttggggtacatgtgcaggatgtgcagcaggtttgttaggccggtaaacgtgtgccatggtggtttgctgcacctatcaacccatcaccgaggtattaagccccacatgcataagctgtttttcctaatgttctccctcccccgatcccacccctgacaggccccagtgtttgttgttcccctccctgtgtccatgttttctcagtgttcagctcccacttataagtgagaacatgtgatgtttggttttctgttcctttgtcagtttgctgaggataatggcttccagttccatccatgtttctgcaaaggatatgatgtcattcctttgtatggctgcatagtattccatggtatgtatatatgtaccacagtttctttatccagtctttcattgatgggcatttgggttgattccatgtctttgctattgtgaatagtgctgcagtgaacataggggtgcatgtatctttgtaacagaatgatttattttcctttgagcctataaaccagtaatgggatcactgggtcaaatggtatttctggttatagatctttgaggagtcaccacactgtcttccacagtggttgaactaacttgcattcccaccaacagtatacaagcattcctatttccccgaaacctcgccagcatttgttgtttcttgactttttaataatcaccatcctgactggcatgaggtggtatctcattgtggttttgatttgcatttctctaatgatcagtgatgttgagctttttttcatatgtttgatggccacataaatctcttcttttgagaagtgtctgttcatgttctttgcctgctttttaatggggttgtttgggttttttttcttgtaaatttaagttccttgtagattcttgatactagacctttgccaggtggctagattgcaaaaattttctcccactctgtgggttgcctgtttgctgtgatgatagtttcttttgctgtgcagaagctctttagtttaattagttcccatttgtcaatttttgcttttgatgcagttgcttttggcgatttcataatgaaatctttgctggtgcctatgtcctgaatggtattgtctagattttcttctagggtttttatagttttgggttttacatttaagtctttaatccatcttgagttaatttttgtatgaggtgtaaggaaggggtccagtttcaattttttgcatatagctagccacttcttccagcaccacttacaaacagggaatcctttccccattgcttgtttttgtcaggtctgttgaagatcagatgacattaacccacttttctaccaaaaaaaaaaaacccctctgtagtaaatgtgtatatttcctaatgagtactaatttggccatatcccctagttgtgatatctaattttttgttcatgtctaaaaatacatcatttacattttgaatgctttctaagcctcagttatttaatgtttaagaatttcccaggcatgtcatattttgttttgtttttgttctttaactatctttgtagcagtctgggtccactcaggagatgggaaccccagggggagcatcatatttaatagaattattaggtatgatgagagagtagctgttaagaggtggaagttctgtgtggtatcgtgggggtggagggagggggacctaagcaggggcagacctgggaaagccccagggaaggaccagcttgttagggaaggtgtggttcagcagtggagagcagggacagccgctggttcaggcagtccagcactggtctagagatgctgttggtcacaataggccaccctctggagtacaggctggggagcagtggcttgaggctgggcctgcggtgtgagttcgggcaccagcacgtccagaggtgccggacatgcagaaggaacgattgctcaacgcaggactctccagaccacgcgggctacatggggtttgtcgagggagtccagaggtggctggccatgtggagctctgggttcgaggcccaacaggtgtggccccaacaaggctgcagggttgcagaagaactaggtgcctctgtggcctgagccgggaactgcgggaaccgttttcctccagcaatgttgctccatcaccctctgcccagaaagcttaatgtgctcactctaaaggagaaacatgaccgggcccggtggctcacgcctgtaatcccagcactttggaaggcagaggcaggcggatcacgaaatcgggggatagagatcatcctggctaacatggtgaaaccccgtctctactaaaaatacttaaaaaaattagccgggcgtgatggcgggtgcctatagtcccagctactcgggaggctgaggcaggagaatggcgtgaacccgggaggcggagcttgcagtgagccgagatggccccactgcactctagcctgggccacagagccagactccgtctcaaaaaaataaaaataaataaataataataataataataaaataaaggagaaacgcttaagggaattctgtttattcagagaacatattgaggggtacattcagaattgggaggcaatgaattgataactgacacaacctttttgtcattcctttctaattgtcccattgtagtcagtgggtgtagccagtacagattctttgtagaatgtcacatttcttttgtggcctaatgctacataggcagttttggttaaacccatgtgagtatgtgtgtgtgtgtgtgtgtgtgtgtgtgtgtgtgtaaaacctccgccttctctatttgttaggtacggggttctaaataaatcttattgttatttaaatttttatatcccatctcatttttgtctggttaatttgattttaatctctcaatatgaatgtggctattaatttcaccttttatcattatttgcttggtttatattttgaagctatgttgtgaagtttataaaggtacatgatgctcttggtggattatttttgttattaatgggaatttttccttttatgcctttgcatactttgttgtttacattcattttgtctgattaatattgccatatgagccttctttttattagcacttgtctggtgtatcttttcctatacttttatttttagcagtcttcgtgccatttttttcaggtgtcatcagaagagactaagcaactcatggcttaattttctaaaataatctgaaaatctatgtttttcaacagatggactaaaagagagtataaagagcactgcattcatttgctcaggctgcggtaacaaaacacagacttggtgtcggaatccatagaaatgtattgcctcacagttctggaggctgggagtccaagatcaaggtgtcagcagggctggcctcctcgggccgtctctccttggccttgatgcccctgcatgtgttcttccttctgtgcctgttgtgtgcccctggggtctctctgtgtaccccaatttatcttttttttttgagatggagttttgctcttgttgcccaggctggagtgcagtggcgcaatcttggcccactgcaacctctgcctccccggttcaagtgattctctgccttagcctctggcaaaatgcccttttcaatcctccctgccattggctacttttaggatcctgctgattggtgcatgttacagattgctgattggtgtgttttacagagtgctgattggtgcattttacaatcctcttgctagctacagagtgctgattggtgcttttttacagagtgctaattggtgcattttacaatccacttgctagctacagagcgctgatgcattttacaatcctcttgtaagacagaaaagttctccaagtccccactcaacccaggaagttcagctggcttcacctctcacaaccaccccaagaaagttgagggtgaagtgcaggccatgcacaggatgctgtcttgatactgagaaaaggaaggtggtgttaaccacagaatttcatggccaggggtgagagttaatgtagcagaggggctctccttggaagggctgtctagaagaagagtgtgtaactctgggcaggataggaagaggtgacacctccatgagaaaagggactttgtcttttttgcccctgtctccccagcctgtggctggtgtgtgtcaaagaggcagagtcattcctgtgtagtcatgatggttagttttgtgtgttaactttgcccagctctggtgcccagttgatttgctcaaacaccagtctggatgttgctgggaaggtaatttttgggtaagatgaacatagtagaccttgagtaaagcagactgtccttcatatttggatgggcctaattcgatcagttgaaggccttaagaccaaaggctgaggttccccgaaggggaaggtcggcccccagacccccttgtgactcaagactggaatgtcaactcctcctggagttcccagcctgccggcctgccctgcagatttcagatttgccagcctctgcagtcatgtgagccaattccttgaaataaatctctttttatatatcctgttggttctctttctctgaaaattcctaatactgtagttttttcatctggtgatctatttggctatctcactaacttctgagttgggacagcctcagagtcagaagtcatgtgtctcctggaccctccatccccaaagcacagccccatgccaaaatatgcctttatgttagtagcactgcccagccctgttcagttttctgagatccagttcctacaagactgtggcactcagtacttttcatctcattgggttctgtgcctctggggctgttgcctctgagaccagatcccggatcctttctttgtgggctgctccacccctgctgtggaaatcacacagaaggcggacagtacatgtggacaggtcagacagacacactgattggccagctgcagcatggggagcatggactctgcccacagctgtggcgagatggctctgtggtgagatctgggctttcttgtgtgctgaggaatgggagcgtttgccatccttatccaagctgcatcactcagggctggcccctctgaggttgcactgtgggccccaccccagcctctgaacgagaattggcataccagccagatgcctaggtgatctgtgcatgtgctgcaggtggagaaggtctgcactagacatctccagaaggacgatctgggatcagggttagacaaggcccacgtctgctgcccagccctctcctctttgatgtcctttctgcacctgacacctcttcttgacattccctttccttggtttatgtggtaagacctctctgtccacaacaggaatggtcttacccatcttcttctcctaccatgtattaatagttccctgtgccttaaacccctgattcaaaacctgcttcctcaactctccaaagtcagccaagcgagaggttatgggcacagtcttccacaagactgccctcacttctgacaccagccccaaattcaggggtcctcaggcccatccttacttcttaccagctggtcaggggttcccatgaccagtcttaaattagataatttgctagaatgactcacagaactcagaacaccattatacttaacaatgacagtttcattatagcaaaaatttacaacccagaaccagacaaaagaaggaacacctggctgggcgcggtggctcacgcctgtaattccagcactttggaaggccgaggcagctggatcacgaggtcaggagatcgagaccatcctggctaataacggtgaaaccccgtctctactaaaaatatttttaaaaaattagccgagcgtggtggcgggcgcctgtagtcccagctactcgggaagctgaggcaggagaatggcgttaacccaggaggtggagcttgcagtgagctgagatggcaccactgcactccagcctgggcgacagagtgagactccatctcaaaaaaaaaaaaaaaaaaaaaaaaagaagaagggacacctagggtgaagtctgggaggcttccagatgcaaagctttggcgtcctcagagatgcattatcctcccagcatccaagtgtgacagtaatcaaagagtattgccaaaaaaggaacctcacctgagcttcaatgtctagagtttttatttgggattctttatgtaggtatgatgcatgatgaattgaatcagtgaattgattaaattgttggccatgtggttgagctcaatatctagccttcccagaagtcaggctggtagcccgtgtctcctgtctcaaagccccaaccctctagtagctagttggcctctctggcatcaccaacctccatcctgagtcatctcttttgcataaactttggaacgcaccacgaataacaaggacactcctatcacttggagattccaaggatgtagaggctccctccaaggtaccagaaggccagccaagttctttattacacaccaactgattgccatgacttagtggttaataaagagtggggcttggggttcctttagatttcaggcctgacacaaccccttggatatagactacatgaaatgaaagtgttaggaagggtgtatgcatgctatttgtttactttgaagagtgacacttggaaccaatgtcagttttacaggctgccctgacttgctggggcacagactgtgaagtgcatattcagaatgaatgaagtgttaccctacagcagtggctctcagacttgcaggcatcagaatcccctggagatcttttaacatgcagacttcagggtcctgcccctgagttttcattggtctgggggagggcccaagagtttctgtgtttgtggagttcccaggtgacactgatgctgctggcccagggaccacacttcaagaagccctggaatagactctgtggtgggtgtttgaactttggattcttggccataggtttttacattacaatgacagaatgggaagtttggcaggaataaagatgacttccacccacaggctcccggggaggtccttcttccctgggccctggcctggtgtctctgtctagcagctagctagcattcaggtcccaggtctcacattttggctggactttaatggcaattgatgggcaagtgcaggctgttcttgcaggggagggagtgctgcctctgcttgggctgctaggcttggggcctggtcacctggggccactgcccttccttcagtcttgccagacaggcagaggagtaagggcttgctaccggggcagagaacatcgaatgattgcaatcgtggggtcattaggattaattagtaaatagccatcagatcttaaaaaatagattcaggaacagcctgggagggcatttgggtgtggtttcccagtttgaggggaaagcatgaatcgactactatctcaggtagggctctggtgctgggaccctgctcaggccagttaagtgacagtggatgtggcctggaaatcctgtttctctcatgttcagtgagggtggaattaggggtgtgtgtggggaccttgggggcgccatgtgatgattaactgtagtctgtctcagttgtggaagctgctaatgtgtttttctgggacatcatcatgggatttttattattgatttcagcagggagactgctggctcattatgtgacaagaaatcgatgtggtgttccacgttcgaagcaggggttctccgtgacgtgcgggccctggaccagcagcctcagcatcccctgggcatgtgtgagcagtgcacactcccagcctccccctgacctgctgagccagaagctctagggctgggagccagaagccccgcaggtggctctgctgcatgggaaggaactgttgggatgcaaagcaggccagagaggacaggagcagacaaagatctgaagctgaatatggacccctcagggtgccagctgtcaccccggagcgcccccctacctggggaagctttggcaaccttcctggttgcaagccaaggcccagggactccaccgctggtgacccccttacctggccctggctgtgccctttggctcagggctgggcccgggaggctggagaggtgccagggttcattgccagaggctgccttgcccctcccttgtgtccttgtaggcagagccctcacccccctatgctttcccgccacccaccagccacacctccttgcccaggcctcagtgcctgacagatggcctgaatacatatatatatattttttgtcttaaaaaactattttttttaacatatctacagactctccccttaccaggtatttcttggggaagaaaatgttgcttagtagacaaatgtccccaggtctccttcagggaggatgagcatcacctgcattgaggaaggggtgcttcagcagagatgctcacttcaaagcgagcctcactagtagccacagggtgcacagctaggatgggaggcagtgctgctgagccaaggggtggtgggagcagctctggagaaacctggtcgggtggtgggtgaagctgcctccaccccagcaagcgatatggggcctccccactggactggggaactgtgtatgagggtttggggtgcagagacctcaggtggccttcaaaggaggggtggccagaggcccagcaggtgactcccacacctcttttacatcatctcctgctgaacaccccagagttccctgcttcttacagtggtaacatttgtttaggagttgtgcagtaagtagaccaggcatggtggttcatgcctgaaatcccaacattttgggaggctgaggcaggcagattgcttgagtccaagactttgagaccagcccgggcaacatggtgagaccctgtttctataaaaaatacaaaaattagccaggcaaggtggtgtgtacctgtcatctcagctattttggaggctaaggtaggaggattgcttgaacctgggaggtggaggttgcagtgagctgagatcacaccagtccactccagcctggataacagagagagaccctgtctccaaaaaaaaaaagagaaagttttgcataaataaagttaaattatttaaaataaaattatttaaaataaaagttaaattgtttaaaataagctaggagaaacttgctacttaaagacatcttttgggagaatttttattcagaagataatcatttatcaaagtgattgagtaacctgtaatttatccagtggagtttaatttaagcatttgaatttcatgtttacccttttagcagctatcattgaacccgtcttggtagctccaaagcacacttaaatatgagatgcagcccctgcctccattggcttatggactgggtgggtgtgtagccaccgtgtacagaaagttaaagatggttctagggaccaggcaaacagcctggggtgagttaccagaaggatgatgtgaatcatcgtgtgagattacaggttgcccatcaccatggccagtgcctctgagggtttgttgggattagaggggcagcttccaggcctttcaggagaggagggtctttacatgtcttttgtgggtgaggacctgaggcaagcagagagagacagccagagttacgtggggctggaagaaatcaggccagagtgactgggacccttgactctccttgttagagggtgtgtttgtccattttgtcctcttataacgtagtaccacagactgggtaatttataaagaaaagaagtttattggctcaaagttctggaggttgggaagtccaagagcatggtgccagcatctggtgagggcctttgtgctgcctcataacatggtggaaggcatcacatggcaaagagacagagagacaagataggggctaaacttaacctcttatgaggagccctctccctgggtaatggcattaatccattcctgacggcagagtcctcatggcctaatcacctcttcagcatactgtctcttaatactgttataatggcaatcaaatttccacatgagtattggcagggacttctgaaccatagcagagggactgccttccccatggatcctggtgtcctgcaccctgggcccagtccactctctggctggcacctctggttttgccccccaggactctgtaagctctagccaaggcagctggtgctgtgcttgccagctctgtgctttgacaacaacttctgccttccccacactgtctgaactccagggtctcctcttcgttttggtgttgggggactctggctcaccacagagctcctctccaggcacgtccctccacagcacctgggaaatccccttttctggctccaagtgacctatcttccgagggctacttgggaattcacagaacctcagctatggagaagctcagaggattgggggattgaaaccgtaggtcatccttgaatggttagcttttgaaaataattgtgcatttttccgtggtatgggttggtttcctgtcctgtctccacagtgctgaaccaaatcagcaacgctgcactttgcaactctgacagttgagcttcctggtcctgcgattagagccctcaagatagtactgaagcattaggtgaacggtggggacagaagcccagactctgtctggagtaggggccctggagggacacacacccacttcctatttggctctgtcctatatgcaggcattttttttttttttttttttttttctgagacgaagtctcactctgttgcccaagctggagtgcagtgaggccatcttggctcgctgcaacctccacctcctgggttcaaatgattctcttgcctcagcctcccgagtagctgggattacaggtgtgcgccaccacacctggctgatttttgtatgtttagtagagacaggatttcactatgttggccaggctggtctcaaactcctgacctcatgatctgcccgccttggcctcccaaagtgctgggattacaggtgtgagccactacgcctggcgcatgcattttttagaaggaccttgagatgatttactattgttgatcaaggaagaagatgaagcggggagatatgctgccttgaaagtgtcctttgagcatgcagccttatttcagctgtatgtcagggtgtgtgtgtgtgtgtgtgtgtgtgtgtgtgtgtgtgtgtgtgtgtgtgtgtgtgtgtatcagggttgctgctgaggagttgcattgcttccctaaggcccaccagggagattcctgtgagggggtcagacagggcctttgaagttttatgtgttattaaagaaggtcgtatcttattaccacaaagacctgggatatctgcagcagggagtggtagaggagaggctgtcaggccagcccttaacagcgtaactctctcattccttcctcagttcctccttatcctcctggcatccagctccccatcagaaactgtgaatcctaagatatgatgggaccatggacccttcacatttttgtcatattcattatagtggttctcagccttggctgcatgtcagccacccagagtgtccaaattctcctcacccagaaattctgacctcatggagctggggcaggatccaggaattgatattttttaaacctcctcaggttgattctagcatccaaccggggtttaggcccgaggaccacagcctgccagttttcgtgtggcgtgacctttcctgccgatgataatgctgatgatgtcaagcctagctgaacgctgatgggcagtgtctgattaatcgaatgaagtaaaaataaacaggttttaacttaatgtacctccccaaatctgtaaagagatccatggatgacatcagtgctgtccaggatggagtaagcccactatcgtccattccactcacggattagaactcaaaactctgaacagaatgaaaagcaaccccatcgggaagggggttggagcttgaatgcgcagcacattagaatagagtttctgtggttgggtttttttccctcctttgatctgagtgctgactgatttgggaaatagcacagtgggcagaggcagcaaaactctgtgagaaacccatctttgtggccagagggttgaaaagaggaacgctgcaagctgaagattaggagggatcactgttttgttttgtcttttcctctctcctggccctgccagacccagagcagtagcacctactaccctgagagaaaatccaactctctggttggaggaaccggttgttgcataaaggtggtgggaagaatccccatttttttctctttctcattctgctttgccctcagcaggggctgcagttgcaagaaactgtgaaagagtgtgatgtgttaggctaaaactctgggagagccccaactttatgggcagaggaaccaggaaaaggtgcatctggtagtagcggaatatggaagaaatcttggagaggggaaatctggaaaagagggtttatttatgtttctgaaccaactccatgtatgggatatacccagagaaccatagcaaaggctttggatttaagctgcaatagaaaccgtggcccgggtcccagacttaatccctgaatagctcgtgcttgaagccaactcacagagcacagcaaagggttttgaaaccgcactgacgttaactccatcccctaacgaaggggaaccagagcttgtgttctcaacctgagtggatttatcgtctgatgaagcagacacatgaaaatcaacattctctacattctcaacattctctctcattcaacatttttaatcagggttaaaatgtacatattaaagcgatctgggatgcaatctacaattatttgggatacaaagaagcaaaaaaatctgactaattcttcagtcaatcaattaaaaatattttttaaatgacccagttctcaagggaaaaggcaattaacaaatgtcaaccctgagatgacatagatgttgaaattatcaaagactttaaagtgactgttataaccatgttccatgaggtaaaagatggacagttctgaaattaacagaaacatagaaattcgcagcagggcaatatgaaaaaaaaaagaaaaaaataggaattttagaatgaagtaaaaatattactggatgagttcaaaagcaaatgtatatgacagaagaaagaatctaagttagctctaagtagatcaatagaaattatcctgaataaaagaaaaatgagtttaagaaatgagtaggccaggtgtgatggctcatgcctgtagtctcagcactttgggaggccaaggtgggaggatcattgagccaggagtttaagatcggcatgggcaatatggtaagacctcttctctactaaataaataagtaaataaataaaattttgctgagcctggtggcacacacctgtagtgccatctactcagaaggctgaggcaggaggatcacttgatccccagaggttgaggctgcagtgagccatatttgtgccactttactccagcctgggtgacagagcaagaccctgtctcagaaaaaaaaaaaaaaaagcaattattaaaaaaaggtatcatttacaatagcatccccccaaaaaagaaagaactacatataaataagaaaatatacaagatccgtatgctggagactaaagaatactgatgagagaaatcaaagacccaactcatggaaagatatatttatattttggaagattcagtatagttgtgaattctccccaaatcgacctatagattcattgcaatcccaatcaaatttccagcaggatttaaaaaactagatattgataatgggattctaaaatttatatagaaaaataagggatcaatagtggaaacaatggttagatccctggtgaaaaaatattcctgattacatgcgggagaatttcccagaagatgaaaaacaagggaactctgaactttgaataaagggcacatgatccttatggactttcttagttctctagggctgctgtaagaagtccacagactgggtggcataaacaacagaagcttactgtctcagttctggaggctggaagtcccagattgaggtgtcctcaggactggtgcctcatgagggctgtgagggaaagtctgtcccatgcgtctccgtttgcttgtggtggtttgctggcgatctttgatgttccctagtttagagccctgccttcatcctgtttgtgtgactgtctccacaattcccctctttagaggacaccagtcctattgggttagggcctacgcaaattactgtatgtcaactaattatatctgcagtaatccccttcctctctctctctcgctgtctcttcttttctttctttcctcactgtgttgccaggctggagtgcagtggcccgatctcagctcactgcaacctctgcctcccgagtttaagagagtctcctgcctcagcctcctgagtagctgggactacaagtgcatgccaccacgtgtatttttagtagagacagggtttcactgtgttagccaggatggtctcagtctcctgaccttgtgatccgcccgcctcggcctcccaaagtgctgggattacaggagtgagccaccacacccagctgcagtgatcctatttctaaacaaagtatattctgaggtacaggggatgagaacttaaacatatgaattttgaggggacataattcagccataacacggatgtggcttattttaaatctacacagtactgtatgcacttggaaatgactagaaaaatgtgaaaatcacagggcaacaagcagaagcagacttttccccctcgagtcttgtggccgcttctctgggggtgacagatttctttgtctctgaggatggatctggtagagggtgtatttagcagtgtacttctttgcacggggtcctggcagctgcagaagctgcgcccctttctccagcatgttaagaaaaaggtcagtgctggtaacgttctgtgttcagttgccctcttatctggaccctcgcttttcccctaaaggcatccaggagcaaacatgacatgcagaggtagactttgccaaggcaccgctatttccagaagttcttgtgggagagagttgacttcttactgttagacgtaacccaggaagaacagcaaataccggccaggccagaagtgcacacagttactctgttcctgttacggcattaatgctgctttcaggcgtggactacattgtgagatattgaaaatgccatttcctggagactagtattgatgatgaaggtctgacagcaattttaatgatgtttaaagggcagatcatcgccctttgcgtatttcgagatgaggatgcagtggggcagatgtctcagcatattgaatgcccagaaggaagaagttaggcccaacattaaccccaagcctcttccaagggctgctgagacttaacacccttcccaccgcagaaatgtcacctgacaggtatggctgcccaaggcttcctgggcttttttatgcttgtcttttttatgttatttgtctgtagaagtactatagccaggaatgactagaggaaggaaataggtaccattgtcccatcactcgaaggcagcccttgctaacgtcttaatgcatttcttcacagttgattctgtgtttatttgttgtgaataaatcataacaatacatattacatgctaagccttttgtaaatatttcagatgccacaaaattgtcttgtggaagtgctaacactgatttatctaggatcctgttattgaaggtttagtgtgtgctcaatatttttgtccatttcactgccgttttccaaagagaacacatccctttgtgaccctaagctaggttagagagccttgcttgacagtgttggatatcagtattgtttttggaagattaatttattagtgtcctttcagagcttgcggttgcctgtgatcttgaagtgaaatacttattcggtgacttttgtctggaatgcttgggctgattatacaagcattctccaggactgttcaaacccacatcatgtatagtgtatagtgaaagcaactaaattatatttgaaaggaacaaaataatattatctttacaacatgtgagaccaaatgggggacaagattggtgtcaggaacaatttggctgagtctgtttctcatttgtatgatacgttttcacccagcctgtattgtggtcactgaatagctatttttcatctggtctgctatattactagctcttctaagcaccagctaatgctattttcccgtgcaaaagaaaaacatggtttagaataaggacactggagctctttattgttgacaatgagcctttatttctcacatctaattagaatgtttcaggaggcgagtggtgagcacggtgtcgggggccgcattagctattgatttatgtgctgttatagaattaattgagtctggacatggagactcattttcttggacatgtagcaggtaatcatgcttctcctgtacatttgaattgctttccagatggtgtgttgtacaggatttatctttaatatgattgactagaagcaaaggacctgagtgtgtttgcatacatgctctgcaatgcaaagcccccagcccccactgtagagatggttaactctctcctggccacaccccccctgggctcatatggggacctgggccttggattgacactgtatgcagcaaagacagcgtcaaagggtcctggataaaggctctgggaggggagaaaaggcctatagtatattctgagggaaacagaataaacagcattacttattatgcaaaaccaggacataatgtgggttcagcaggggaatagttagtgtcttagtcagctcaggctgctatatcaaaaaacaccatagacttggtggctccaacagcagacatttatttctcacagctctggaggctgggaagtctgtgatcaaggtatgggcagattcagtgtctgctgaggtctgtctgctttctggttcataggtggccatcttctttctgtgtccacacatggtgaaaggggcaaggcagctctctggggtctttttcttctttcttttttccttccttccttcctctctccctccctccctccttctctctctctctctctctctctctctctctctcgtctcgcactgtcacctgggctggagtgcaatggcgtgatctcggctcactgcaacctccgcctcccaggttcgagtgattctctttgcctcagcctcccaagtagctgggattacaggtgcacgccaccatgcctggctaattttttttttttttttttgtatttttagtagagatgggatttcacaatgttggccaggctggtctcaaactcaagaccatgtgatctgccagcctcggcctcccaaagtgttgggattacaggcatgagccaccacgcccggcctggggtctctttcataagggcacagtcccactcatgagctccaccctcatgacctcatcactccccaaagaccccacctcctaatgccatcacactgggggtcaggatttctacatgtgaattttgggggcgatgcaaacattcagtctgtagtggtcagatgatatctattcagctgggaaataggatgtagccattaaaatgatacctatggagagcttgtgttgcttaccgcatgttaaaagagaacaacatggatttgtgtttacagtaaggtctcggctatgcaaaagagatgcacagataaaagactggaaagaaagaaaccaccaaacaaacactggctttctatgggtggaacaactgtgagtgggcatccattcctctctatatttcctattaagaacacagagcaaaacagattgtagtccttgttgctgggaagtaatgtgccctcagaaacagtcaccctctgagtacagaagtctgcccacatcagtttcacaaatgatgtgctagatgattagtcatatctccggctctctcctgccctcctacagggcagctgtccccatataacagttgtatccctagaaggagtatgcagttaaagtaattggagattctttgaccagacgttttgagagtctggcagcccggaaaggtgggatttggcagctatgtgggaccttccttcaggcactaaagggcttcctgaaaaagttgcttacacattgaggtgtgttaaatggaattctttatcataaggctgcaaactgcttctgtgcaaaaggcaatgtgttagttccttgcaggaatatgcttttagtgaactcaatgagataccagaaatccagtaggagaacactttctttgaaagaaccacttgtttctacctacgtttttgcccacctttccttctcacctccccttggccacaccccacttttgtgtcttgggaattatctgctgtgctctgaatagccccgtcctgccaggccacccacctttgcccttgtttgaagaagctggggacagttgtccttgctctccaccccctggagtaggggaagaaggcttggaatgtggtgggcctaggcttcttggtgagggccttgtatttgttgacaaggaggtcagatccattccctgggccgtcatcagagacctgcaagcatctacttagggcagagttttcaagtgcagtctttggacctccaacatgagaaccacctgcagctctagacctggcctttggcccacaaccttggaatcttgggccatgaacctgcacactctccaggtgggccttgtgcccaccaaagtgagcgaatcactgcattggaggagtgactcttggcttttcacaaggacctctccctgctttcctcagtccctccaagatgcacccatatcccactgcagggatgcaatttgcatacatagccagggacagtgtcatctggccacagccactcccagccacctgtgtcagcagagttccccgttcccatctaagacattcacctcatcaggcatctctcctggaccatttcattgacattttccttaactccctttatgtagtgtttatggagttcaggcctgcactggttgctctcttctttaactcgcttcaagccctgcaggcacatactgtcattttcagtttcctaaggaggggaaggccatctctccattaaatatcttgccccaggcctcacagtaaacagaggtctgaattgaaacaaggaccttcagtcttcatctttaacaggcgggctctttgtcttataccaaaagtgccccagtaggttccgtgtaattctgtggagtctttgaagacgtggctgccttctgggtagctgctgtgggtcccttaccctttgcactcatgggaaagagagctggatcagaatgtctgtggtgtcaaactcaggaaaagagctgccattagccagcgctagcattgtagtcatggtgaaaaacgggatcattaccagtccacagccaagccatattgcagcctgaggcaacaggaaaaatcaggaataccaatcctatcttcatttacaattttgatattttgttcatcatggatttattttgccttagttttgatttctaaagcattgcattaaaatattatttatttttgattgcttaggtttttggggcctccctgatctccccctggttcagccatcgtaaagtgaaagcattttcattgcaatgaggaataagtcaagggtgcctgttagtgccattgttaactcctcagggaagtgcagggcagggtagttagacaagatgaccacatgccggaaaggggaagcaaaatggtgacttctgaaagtgacatcatttacctagaaaaacattatcaactaaaaactattaggatttaaaaatagcttagtaaaatctatttttacaaaatcaatatcattttttttctgtatgccaacaataaccaggtaaatatataaggaagagatctattcgcaacagccacagaaatattatatttaagaaaaaacttaatatgagatgtctacagctataaagaaaattacaaagccgttgagagacatttaagacttcaataaataggaagatttttttgggtgaaattgggtaaaaagactcagtattgtaagtatgaataatttctgaggccggggcacggtggctcactcttgtaatcccagcactttgggaaaccgaggtggctgatcacttgaggcaggagttggacaccaacccggccaacatggcaaaacttcatctctacaaaaaatacaaaaattagccggagggtgatgacacatgcctgtaatcccagccactcaggaggctgaggcacaagaatcactttaacccaggaggcagagactgccgtgagctgggatcgtgctactgcactttagcctgggcgacagagcgagaccttgtctcaaaagaaaaaaaaattccctaaagtaatttataacttaaagttactccagccaaaatttcagtggaatattggggatacttggaaccactaactcttaagttcttttgggagaataaatgtgaaaatagcaggggaagatgacaaaatgagaataatgagagagaacttgccttatgtcgtattaaaatatgctctaaattcataataatgaaaatggcatggtactgttgctgggcagatagaaatgatgtagactagaaagtccagggacagatctaagtttatgtaagaatttagtgtatgatggctgggcggggtggctcacacctgtaatcccagcactttgggaggctgaggcaggtgaatcatgaggtcaagagatcgagaccatcctggccaacatggtgaaaccacatctctactaaaaaaaaaatacaaaaattagctgggcgtggtggtgcgcacctacctgtagtcctagctactcgggaggctgaggcaggagaatcacttgaacctgggaggtggaggtttcagtgagccgagatcacaccactgcactccggcctggcaacagagcaagactcagtctcaaaaaaaaaaaaaaagaatttagtgtatgacacgcagggtgaccagccatcccagttcctgtggaactgagggtttcctgggacatgagactttgagtgttaaagttgagatggttggtcactgtaaaacatgagaaacagaatagtctatttagtaaagggtattgggttacctgagtaaagctgtggtgcccacactttgctgtatattggaatcacctgggaaacttttatgaatactgatgcctagttcctatctgagacattctaggttcattggtatgtggtgtgacctgggcatcagggttttcaatgggtaacaaaacttgaaaatcactggggtaaccatcgtggagaacatgaagctgctccctaccttgtgtgtttacactttctgatgggttaaatatttcagtgtcaaaaataaaggattctagacagtgactggatttgcttgctccaagggaagaggtttgacccctcccatgaaaagtctggaacttctggagctagggacaggtgcagcacacagactcagggagtttcaggggagcaccttattcctgtgcctctaggaagggtggacattttccctggaagcaagcagatctggctgaggacagcctatctctgtcatacctaaaaaatacaggcacctcttcacatctcaacagtgaagtcccagatgaccaccctgactgcctccagctcaccataaaatcctctcccactgtatcttacactgcccagccatccaccagtcgctgaaagacatgcactggtgtctcaggggccctttgttgccagcaagagcaaagacaggtcacatgctatatcttgctgaaaagtgagttagtgttttggaaggtcaaatggaggaactaatttataccacacagaaaaaaatgtgaaatgggtgctatgagtgtaaagttcagtgatttggagggcaaattccagagatattccagaaagagaaaaaggccattagggagagaaataaaaaagaaatagcaagaatcttcctgtaactaaagtaagatgtgggacttgattcggaaagggctcaccaaatgaatctcacataaaattaatgagaccctcataaaattaaaaaagacccttatctagacatagtttgctggaatttctgaactctaagagtggagaggaaattgtatcagcttccagacggaaggaatagatttttgtaccaaggtaaaaagaatctgaatagtattaaaatgcacatctgcgagactgtaagctagaagatagtggaacagtgttagcaaattattgtgaaaaggatgcaatacaataatcttatacctagcaaaggtatcattctatgtgagatcagagccattttatagatacaaaagagttacctcctaagtaaacaaaatgactctaacaattatttttacaaaataaaaatgaaatcccactaaatagttcaagagaaagaaatgcaaaaagtataggaagcagtggtaagttatgaattgagtaattatagtccaaattatattgttgtcgtagtgttatacatctggaataaatttttctgaaatcatctgaaggcttggagagctaataggaaacaccagtggaaaataaactcctggttctattgtagttctcctacaatgtcctcagtgttttcatttttgaaaacttgaataacattttaataggatctggactgttccatgttactgtaatgtgtattttagtccttatgtcctatattggcctagagaatattttatttagtgttggtatacatatttatatgtgcatattacagattttatccccccgaatgacagagattttgaagttaagatagcaagagtactgtgtactttagtttgttctcttaacaaggatgtgcataccttcaacgtgcacagcttgatgtcagagcctggcgagaaacagggatgctgtagagatggcaccgctatgcaaggaatgggagctgtgtgctcatgtgccagtgatgtaccatctgccctttgccgtcctgacgtcaagacatggacgtctggttgcatgttagcagctgcattcagcacatgcttctgagagaccgttttgaggaatgtagttactggagattgtgtctgagagttgtggttgctaagtccctgacatcactcctgcagcctctctcttgtggctggctgtcctctgtgaagataagaaatctggtgacaagttatatgtggtctttgaggcagctcagtgttcttgatgtgtcctctgacacatctgggttgcagatgtcttagtgagtgctggccccttgttctcttctagggaacagctctttcgaattgtcctgccagtttcagggtttgcgaatggggtgacgggccctgcagggtccatctcagtgacaattttcctggtgtgggacatctttgctgtctgtgggccactctagggggagtgctgtgaattgctccgcataccagtgatgctcctgaaacacggccatggacaagcctgtgcaggtggcggagtaaacattgcttctttagatgtcaagtgtccttggagtgaattcacacgttggaagcatgtggctccatcagtaattgtgcccacactctgagtgtctggactggatgaaataattatctccttcttcgttcttttgggaatattcatactgctgtaaccgtgaccatctggtacactcagtctcataacaagatgtgttttgggcaccactacaaacaaggtgctgtgtttggagctctggggggatacacaatatggaaggccttgagtttgtggcctaaactaaagagacaagaggggaagaggaggtacaggaaggcaagatgagagcccgggcagtgactgctgagggtcactgatagctcctctttcatcttcacttcctgctcccatctgagcccagatccctttgcttctgccacctaaggtcctcactgagccacttctccactgtcctctctactgttttagtttaagctctccttttttttctttttaaaaattgcagtaaaatagacataaaaaatttagcattttaagcattttcaagtgtgcaagctcttaactggactactggaatatgtttttttaaataattgaactatcatgcaagcaaaaaggcatgtgtaatgtaagagtacagtttaaagaatatgacaaacatttggggaagcaattagctgaagaagtagaacgttgctgggcgtggcggctcacccctgtaatcccagcacttttagaggccgaggtgggcggatcacgaggtcaggagatcgtgaccatcctagctaacacggtgaaaccccgtctctactaaaaatacgaaaaattagctcggcatggtgggggacacctgtagtcccagctactcgggaggctgaggcaggagaatggtgtgaacccaggaggtggaacttgcagtgagctgagatggtgccactgcactccatcctgggcgacagagcgagactccatctcaaaaaaaaaaaaaagaagtagaacgttaagcaaacttttggacgtcctctgtgccactttcctgatgctagccccttgctttcccccagaagagagaatagccttttcactggtctccctgcctctagcctctagcctctgtccccacgccaggcccagagagacagggctaaaagaaaaaatgttgaaaatggctcagtgactgtgcacatgtcttagtctgttttctgttgctataacagaatacctaagactggttgattataaagaatggagatttgtttctcacagttctggaggctgggaagtccaaggtcaaggtgccagcatctggtaagggccttcttgctatgtcatcccaaggcagaggtgagaaggtgagggagaatgagaaagagagcaagagagagccaaactcacttttataacaaacccactctcacaataaagaacttcctcccaagataaagacattaatccattcatgagagcacagccctcatgacctaatcacctttcaaaggtcccacctctcaacactgttgcattagggattaagtctccaacgcatgaactttgggggacatattaaggccatagccgtgtggtttgggggataaagtgcagagtcctgggcactgggtccaggccctctcccagtttggcctgccaggtctctgcagctgccctgtcaccccacgatacctgcaggctgcggctgcaccctttgtcctcttctccccatggccgagcagtgctgtcccctctgctgagccctccagcctgccacgctggggacttgtgtagagcttttctgcacattgctcagcctggatggtccctgcgcatccagttcctcggtgaacattgttcagtttgagggggaagaggagggagaggatgggataagcctgaaggggaaggtacccaagatagtctttgaggggtcatggatttagattgggaagagttattgtccctcctcattggtcctcattatgtcttcttaatgaaagctgctcattttcttcgtgagagcaaacaacctgatcttctgaccatttgtcttggtcacctgggctacccaaactgagtgagaagtcaggaatgagccggtaggttcctggggagaggcgtgtgtcctcgtgagttgccggtgcctcccttgactgcttttcccggagctctgtgtgccctcgttctccttggtgtggatgcgtgttgttctgatgatgagttagcgggggtggggatggcgcactgtttgaacagatgtgccctcacatggctgcgggaggacgtggtgggaggtgctgtggtgaagtggccccacacatggctgggctttgtggggttttgactctgtccttcccaatgttcctccccacagtggctgcctccgggtgatgatggctgtgtgaacgactgccatggcccaccggaagcttgagagcgtggggagcggcatgttggaccatagggtgagaccaggtcctgtccctcacagccaggagcccgagagcgaggacatggagctgcccttggagggctatgtgcccgagggcctggagctggctgccctgcggccagagagccccgcgccagaggaacaggagtgccacaaccacagccccgatggggactccagctctgactacgtgaacaacacctctgaggaggaggactatgacgagggcctccctgaggaggaggagggcatcacctactacatccgctactgccctgaggacgacagctacctagagggcatggactgcaacggggaggagtacctggcccacagtgcacaccctgtggacactgatgagtgccaggaggcggtggaggagtggacggactcggcgggcccgcacccccacggccacgaggctgaaggcagccaggactacccagacggccaactgcccattccggaggatgagccctccgtccttgaggcccatgaccaggaagaagatggtcactactgtgccagcaaagagggctaccaggactactaccccgaggaggccaacgggaacaccggcgcctccccctaccgcctgaggcgtggggatggggacctggaggaccaggaggaggacattgaccagatcgtggcagagatcaagatgagtctgagcatgaccagcatcaccagcgccagtgaggccagccccgagcatgggcctgagccagggcctgaggactctgtagaggcctgcccacccatcaaggccagctgcagccccagcaggcacgaggcgaggcccaagtcgctgaacctccttcccgaggccaagcaccccggagacccccagagaggcttcaagcccaagaccaggaccccagaagagaggctgaagtggccccacgagcaggtaggaccctggctgtcctggggaagggagcagaggggcccgagagcaagggacctcagggtacaggccttgcagatgctgaagcgaggcggtggggggtgctgggtgcctcacagttctaatggtggctgagctcttcattggtccagttgggagacatgttgcgtggatgctccggccactcttaagctcaccgctcagactcaggactaaagccggttgagggctgagtggcaactcgtgtctcgcagaagacacccctcctcccaccctagaagagaggttcgatttcttgcccactgccctggtctgctcatggtggggcagtatgtgtgggagagcccctcaatcctcaggggtgtactcagaccagcagggcagtggcaaagacgtgggggtgctggtgctcacccactgctgcggccagtgttgggtggcctggtggctggggtcggggccagagtgcatttcacaatggacgggtctctgaaagcccgggggccttggcctgatgggcaatcagctgtgaatacctatttggaaaaggattttttgaaggtttgacaaaacctcggggaagaaacgcatgctaatgagggcagtggatgtcagcataactgtattttaattatagcaaagtcagcgtgcattctaataaacacatttgaaaagccaccttccaaaaaaagcctcactgtgagtatataaagaagatgtgattattggacttgtgtgaaggaacttctatttggccaattatgtggacttctgtcatatttttttacagccttaactgttaaatatttttttccgagaagagttcatgaatttgagtgtgtgtgtgtgtgtgtgtgtgtgtgtgtgtgtgtgtgtgtgtactgagagcttgggtttggaatggaaatcattggattttcagcacttatattttaattgactcctggattttcagcacttgtattttaatgtcttgtattctctctaaagaacgttaagtgtcagttgacttcactttgggggtgttcctgtcattcacagcaattccgtgtttacagggggctgtgggatgcataggagctcccatggtactagtgggtgttgggagagttcacccctaaggccaggaggctctggaccctgggtctgggctttaggccaaagcaaagtgtttctttggtctttagcagggcctgggcttgtcccacaacagtggtgaaggcacctcagggattgacgtgggctgtgcagagcgtgtgacatgctgcgtcttattgtgacaaatggcatcgctagccaagttcttgtcaaagaagattatctttagagcgtggtggggagtaagcaagacctgatattttctggttttgtgcttcatgctaaccagatggtaatttgggtaaaaacacagagatcttgcgattggagagctgggaggtaaatgagtgggaatgaatggatggatgggtgatagtagctgtttaaaagggcaggtggaggtaggggaagtccccagccattgtggaggatcaagaggatgtctgttcttcccagaagaggcattgaatgaaaaagtatgtcacttctccccctaaggagaatgtgtccttgaaggacatgctcttgtctgagacactggaaaagttcatttaaactggttaatgattgtatagcttttgttttgttttgtttttccctccctccctcctttctgtcctttcctcctttcctcccttcctcccttcctccctccctccctccctccctccctccctccctccttctctccctccctccctccctcctctctctctctctctctctctctctctttctttctttctttcctatcagttcacaaattaattctgtcaaggggaacacctgctagttccagagttccaggctgacaagtaccctggtgccaggggccctgactactctttctgaagactctaccaggcccgctgcacgtgggcagggtctccacattcttagatttgagtaccccattccagatgaggacctctttgaaacctgaccagaaagagccgtagaattcatcttgaaagcaagattttttatgaaggatgtgcactgggagatttggtgctgccttgcttgaaataacaacctgctttcctaagaacaatccccttcctcccctgggggacagccaggccgtgccaggagccaacaaaggcctggcctcaagcaggtgcacagggtgccatgtgtcccatgctcacctctctgatcccagtgctgtccacatagtgtagtgatccctatggttgaggctgcagtaaaaaaaaaatctgaagggagaaatgggcaatattggtcacttagatgctgtagactcctgtttttaaccctaacccagcagcattggcattactggggagccccgcccccacattgctgaatctgaaatctgcatttcaacaagatgccacattccagctgtgatgctgtaggagactcacttggaggaaattgtgtagcaaccctcccctctcttctactcattttacagcttgaaaaagtgtgtcctggatattttgaagaggactgaatagcatttagtcattgcacgaatggcaatagtaaaatagagttagaaaaaatgggaagatgaaaaatgtattctccatggtccctactaccctaacggatgagctatttcatcagtgtgccttttcagaccatagcattgagcataaatgatgtacgtagctgtcatcataacccagatgtatttttgtcatacagtttttaaaatctgatgtatgataaatgtttctccatgtcaccatataattttcatgattatttgtagtgacctttccatgatccatttgggcgatgatgtgctgtataacatatttctctgtacacactctaccattgagcatgcagattgtgagtggcattttctcttaggtgtaaggctgccacagacatctttgtacaaaccatgttttccttctttggtttattacctgaggataaatccccatgccgtacatcaacgttgaccatttcccctcgatgaccttgcctaattgtttcccttcttctgtggatgttggatgcatgccctttatcttttggggtttggatgcatttccatctcatagaagcactctctacactgtaggtgtgacttcctgttgcgtatgtcctcatctttagtacattttcttttgaattttggttatattattttcaccatctctgcagcatttttaagatgttaatgactcatctgtgacccctccacctcctttcggtacagagggatttaattggatgtttccttcttccctgtctgggtagatgtattcacagaggacattgctttggtctggtcgatacgaaaaatgagttgccggctgggtgcagtggctcacacttgtaatcccagcactttgggaggccaaggtgggcaaatcacctgaggtcaggagttcgagaccagcctgaccaacatggtgaaaccctgtctctgctaaaaatataaaaattagatgggcatggtagtgtgcaccagtaatcccagctactcaggaggctgaggcaggagaatcgcttgagcctgggaggcagaagctgcagtgagccgagatagcaccactgcactccaacgttggcaacaaagtgagactcccacctccaaaaaaaaaagaaaagaaaaatgagttgtgcctgtactaagaagtaggttgtgtggcctttggagccctcctgagctgtaggatgccatgcattttgaaaaggctccagtttgcagggagccctcccacctgtgccactctgctgagaccaagaggtctgcccgggggctgggatatgagaggcacaaaggtgatagagtttctaaaattgtaggaagacaggttggggaacagagatctacacttgaattattttagtaaaataaaaaaaggttatttcaaagcactgcaagtttactgaggaaaatttggaaaatacaggcaaaaaaatcttttgccatgtggcattgtagaattccactgtagagttttcaaatcaaagagacaaacctaggtcaggatttcccaaaacacgctcttagaggtgttgtgtaaacaaagtaccatttgatccttactattcatggatttgatatttgcaactttgttaacttgctaaaattgatttgtaaccctgaaatcaatactcgtagcactttcccagtcatttgtggaggtacagagaggggaagaatttgagtcacccaactctcacgttcccagctgaggttgaacaaggctttgccttcttgtttcagctctcatactgtaaacagctgttcttttcacaatctatttaatgttctttgcatttttgttgatatgtgtgtgtgtgtgtgtgtgttggtgataaaatggccctcaagtgtggtgctgaagcctagtgatcctaagcacagaatggctgccatgtgccttacatgtgctagagaagcttccttcagggctgagcgacagtgctgactcgtctatgctgccactctgggaggtgctaaagtaaacttctgtagcgtatgatgaagttaaggaaaaggtggaggaatggctaaatttgcagattcatgggacaataactgattaaaaaacacatagtggacaggtagaaaacccaagaactttactgtcttgtgatctagggtcagggaaatgttaaactcttctcagctagtgttttatgttaaagaaatattgcatataattaattatttataagaaatctatattaaacaaggtgcgtataaacagaaacacacataaaacaaggttctgtgttgattcattgacaaaaatgtgtcccgaggctcataggaacctaaccctgtatcgcccctaggagcaatgtattcagtattcatcaactcagtgctcagggcagctttacagaacataactatgtgaatgagaattggttgtatttggttggcaaatgactttgggaaactttgctgcaaagtttttcccttcttgggggtttactgatttctcacacacaagtagcataaagtcccacgttcgctatagcggagacaccagccagcctggccagtgcttcccaaacatggtgtatcagcaagcccttttccctccatgcagggtctgtgggagaatacagacccaagctttacaccctggggagtaaaggacccgtacacatgaactcccaaggcctctccctgtatgcttcagttccaagatgattcagcaaccccaaatggtgatgatggaaaggttgtcattgtgttatcatcaggacccttggcttctgcagatttaacctttcttattttgtggtttgtgtaaagtccgtgggtgccggtggaggtggcagcagtgttggcggtgactgccagcaccatgttaggggtgttaggaatatgatcgcagtaaatcctagagcaacccagagagagggagctagggttagtcccgtgttgcagatggcacagttaagtagctcacctgtgaatagactgtggactgtgttatgccaaaacccgtgcctctgaacagtgcataacacagcccttgaagaacctgagaagagaaagcgtccagttctgttcagtccgcgtttgagcctgcctgctggagggtgagtcagtgtgggggaactgtgcagtgttcctcctggagagtgatggtctcttctcctctgttgtctgtttccttgctgttgaaaggcttggcgtgccctgttgttctcagtgagtgggatacggtgccagtgaggtgaccagtagatacggaagcctccggtctgtaaaatgtccccatctcagtgctaacgtgtcctaagttcaccagggctcaggccacagatcaaacaagtcaagtaaagattgttcatgtggcatttttcttaatttttttgagctttgttgacataacgtattgattttttttttcatgcagtgattaaggaatacatgagttgggtccagcaaggctcgtattgtgtgacctgatggaattagtattactacacctacccatgtggccctctactatcaggcagtgaagcgtgagtggagggaggaccccagctgggcactggtacctggctcagtctcacagctccagggatgagcctgtggacctggcacgtccttggtgccttcccttgaagagagtagtttgctcatcagtgctttccctggggcaactcacccacactcctggggggcaccataagagcgtttgtccagcaccaaagatcctagttctgtgggtctgtggggtggccctggatggcatgttctctggatgcctctgggtggcctgtggaacataaagggtttggcgagggctggacggattgttttggagccccatcccacctgttaccttgtgacgtctatcaggagatacactgaaaaggtcagccctgcctgaaattctccctgtagagacttactcctttggaccttggagatttctggagctgcaggcattccttgtccaggacctccatggctaccgagttgaggtatttgatttactcagcaagtgtagaatagctccacaccttggaatggcaaaccaaatatgcgttttgattatttggggttttcatgatttctgtttatccctgacccagctggtgctttctagaaagagccttctgccaatagaaaaaagaagaaaaatcaatacatggtagccaacttaatacaagttaaagggaagcatggtcgagggccccgaggccacatcgaatgcagaattgtgcatcattgctcattgtagagatgctttggccgtgacttggcattcagtagaggcttgctttttgaagaaccttctgagagtgtgataggagtctggtgccaagggagagaaggtgctaaaagcacaggtaactgggtgtgtcccccaggtgggaggcagtggtaccgtgtgtgttctgagccacggcctcacacacatgccccgctgggcagcatatgaagtgagtgtcagtatctgctttacagaagaggactgagacaagagtggcatggggttgttggcacccaggcgccccccctccatcagcgtgtggtggggcagcaggtgtgcagatggggtggtcctgcacagaggggctttggggcttgcactgcgcccaggagggagtggtctggggtttgtctaaacctggcccacagtaggatggaacttgggaaagagcctgtaggtggtgctgagggcagggggttatggggggcattggggcatggtctgcctgggaaggggaaggtcctctccagcccccaggcctcagtggagtagtcggctccctcctttctgcagccatgcctcagattctagtgtcccttgccccgcccacccatggcgtcaggcctagcactcctgctctgcatacggggaggctgcacgggagggttcttggggtgctcctgtgtcccctgtcgtctgtactgaaccccttcccgtgcagctctgctcccagcactgtgacagggtggacaccgcacctcctgctactgattcccaggattgccttgaaaaataaaatcctacgggtgtgcattgacgtttcaatcctggctggctccgcatgagcttctgaacttgatgttcagaagctcagggcccatttgctgagtcagcacagctgccttctttgatttgtatgaagccttttgatgttttgatgacatgtcaccatgggtggctgttattttcagggagcagtttatctatcaggatctgggattgcttcgggtacttttaaaatctaggtaaagccggggtttctaaaacattgttctaaaacattgtcagggcagagcatgtaaagctctcccactaccactaatagtgatctaaaaagtgcctctcccctcaaacacaccctagtcctcggggagaaagcagagtgcggtggttaggaatgctggagccacagtcaggaagccggcatcccacccggctgcagcagcttggggcccgggaacattctggatgggccacctgtgccagcagccccccatctcgtggggctgtggggaggggagttgatctgggtcagtgtctgtatgggtggggaggggagttgatctggtcagtgtctgtatgggtggggaggggagttgatctgggtcagtgtctgtatgggtggggaggggagttgatctggtcagtgtctgtatgggtggggaggggagttgatctggtcagtgtctgtatgggtggtgcggggagttgatctcggtcagtgtctgtatgggtggggaggggagttgatctggtcagtgtctgtatgggtggtgcggggagttgatctggtcagtgtctgtatgggtggggaggggagttgatctgggtcagtgtctgtatgggtagggagggaagttgatctggtcagtgtctgtatgggtggggaggggagttgatctggtcagtgtctgtatgggtgatgcggggagttgatctggtcagtgtctgtatgggtggtgcagggagttgatctggtcagtgtctgtatgggtggtgcggggagttgatctggtcagtgtctgtatgggtggggaggggagttgatctggtcagtgtctgtatgggtggggaggggagttgatctgggtcagtgtctgtatgggttgggagggaagttgatctggtcagtgtctgtatgggtggtgcggggagttgatctggtcagtgtctgtatgggtggggaggggagttgatctggtcagtgtctgtatgggtggtgcggggagttgatctggtcagtgtctgtatgggtggggaggggagttgatctgggtcagtgtctgtatggatggtgcggggcatggagtgcttgtgcagatgatgatgatgatgatgagttttcagtccatgggaagctcatcgggtctgggggaggtgggtgggcaagtccctgcacccagtttgggtacaggccatgctgggcaggggtgaggacactagtggacctgtcctcgggagtgacacaaaggaggtggtgagccctgcttgtgagataggatgagaggaggaccaggactggtcagggccacactggagctgctgggggtgaggtcgggtaagggcctcccaaggtgcccccacgctgtcccctctgcagggccctcctgaatgtggcttgtgccctgctggagaagttctcacatgcctctttctactccagagtcactgatttgggagatggggcaacagctgcacagccccaagggctgccctgattttctcacaccgaatatctaataggaagttagctgagaagcccacacacctcttcttccaggtaggcaagctgggcctgggactacctgtctctcaccgactccaaatgatagccaagcctctcttaaccttgggcaccttttttccagtttccaccccgaattcacactcttcaaagccagctcctcctgctgggctgctcctgatgtggggggccggccctccctgcaaatctctggcatggcccttgcaaattggcacctgccacgtggttggcactgggactgcaaaggtgaaagtggcattatcctgcatttgaaactcattctagagggagacggatacatgagactctccccgcccccatccaggtgtggccaggctccagacgagttccaggcaggcttccaggacaggctccagagttagggacaggcggagaggctctgtgactttgagaggggctttgggaagtcagccgacaaggtggggatgaacatagaggtgtgtgggtgtcctcagcatggaaggggctggaatcgtgatgtggctttgagcctgaaacaagacaaagggaaggcgagggacatgggttgggggatggtgatgagagagagacagagggttccactgggggcatggaggggagccaggagagaactggggagctgaggggagggacattaggaaggccagatgtagcagggcagttaggagatatcttactggggaagaaagcacccgttggcggtggccacctgttggcggggtcccctgagcctgagcagctctggtggattgggaaggcagaggcatgggaatggtagatggacagtgtctatagagacttgcacggagggcccaaggaggtgccagcaagccgaggtgctcatagtgtgtgtgtgtgtgtgtgtgtgcacgcacgcttgtatgtgagatattgacttgcattgtactcatctgccggtggggtgtctagggcagattgtggggagtgagagcattgggtatgggacccaggctgtccacgtgcgtctgcttcttgaggccccgtacctcccgttcttgggcctccgtgacacctggcatcatgcctctcttgcaccagaggcttgagagacacccagttggcaaaatcagttagtctgtgacattccctaggaagtgcagggctcggtgcaagaagttatagaagtatctgtttaggaagaaagatcgcatggctgaacacgctgagatgcgtaatgtcacccatggtgtgcttgcccaagatgtgatagcgtggtgatggcagacatgggagttttaccccaaagcattcagatcacaaccagtgccagtcagttactatgaagacatgtgactatggtaatagggggctgacctattagaataactcctaatcctatgtcagataataccatgggcagctcaagaaaactacgcacaactcagacatgtggagaaaggagatgtggaatggaatggagccctctgggctgatagaggcctccaggacttgccacacccacgtctgcccccaattccccagtcagccttcacagaagagaagttggtctctctccagctgagaccaagccaagacccaaagtgctggagctgaaggaagtttgggctaggctcacagaagctattgtcccctcctccagtgtcaacagctacccatggtccaggcctccatctggtcctggtccttttaagagacactgggtgctgactcacttctgggtctgtcccacgggtggcctgcctggtctgctgtgggtgcagccagactgtgcaggttcgggagcccgaggtggacttcaggtagggagacgctgctccccaagagctgctcgggtgtgacgtcagggtggaggctgttgctgtgtgtggcggcatcagtcatttaccctctttctcattagcccctgtccttcggcccatgtgcttgcaggtggcctctgattctgcttctggagactgtctgccccctctgattcattcattgcggccccagttatgtgaaagatagcatgttcattattcattcattgggccccacttttagatatacttgtgttcatcttcgagagagggaggtcatccagccattccccagtcctcaaaacccactccacaggcaaagcagtggtgggtcagggctcctcttgctgcattgcggccttgtatttgctcttctgagccacaagcatagcgagaaagtacaaaagaaaaggatttcaatggtattcaccctgaaaaaggaagaaaattgtgacacaggctgcaatatggacaaaccttgaagacgtcctgctaagtgcaatgagccagtcacaaaaggacaagtactgtgtgattctacttctgaggcacccacagtagtcagagtcatagaaacaggaagtagagtggcggtggtcaggggctggagagagcagggagtggggagctggtgtttaatgggtgcagaggttcagttgtgaagatggaagcattctggaggtcatcggtggtgatggtcgctcaacagtgtgaatgtacttaatgccactgaattgtacacttaaaaatggttaagatggtaaattgtatgttatgtatacttaccacaataaaataaataaagaaaagaagaggtttttcagtgaataactggtttgaaccaatttggatcctctaaaaccaagttgagccagtctgaacccatgtagccattatcacaccgtgttaggctattcttgcactgctttaaagaaatacctggggctgggtaatttataagaaaagaggtttaattggctgacagttctgcaggctgtagaggaagcataatactaacatctgcttctggggaggcctcaggaagccttcaatggtgacagaaggcagagtgggagccagcacttcacatggtgagaatgggagcaagagagagagtgggggttggagggggaagcgccacacacttttaaacaaccagttctcttgtgcactcaaagtaaaacctcacttactaccaaggggatggcccacatcattcatgaaagattcaccccatgatccagacacctcctaccaggccccacttccagcattggggattgcatttcagtatgagatttgggcagggacaaatatccaaactatatcacccacaaagaagcaaaaacattttgggccaaatcaaaactatttagatgtagccacagtggggatgaactgtgattatacccattcaggcctgtggacctgtggacctggcgtgtgtggtcgtgaggcggtgggtcggcacatccctgggaggtttcaggaggacattcaagaccaaaatgagccatgagtaaataacacaaccacatcctgagtgggagtaggggagcctccccttctctcctaggtcttgtatgggtcatgatcccgccttggcaggagtggaaggaacagatcccacaggctgtggcttatggtaaagtgattgtggtcatgccttgtgagtgtcattaaaataaacatatatcgttaaatccaccatcaaataacagctatttctgccatcctctcgccttttccacaagtttaaatatcccagatattctactgtgtatattcctaaaagcagacaggtagatttagtaaagttaactggatcattggtaccttctttatagatcatctggtgaaacttgtttttcaaattatgagttgtagggctttgttttaatgtctgtagccttaggcagttccattgagactaagtttttttcttattaagactaatcttattgactggaactgtggactcctcgtattaggagaacagagatgtggcctacataaattagtggaagttaaatactgtagaaaatgctctctggaaaccaaagtctaacatcgacttactactggtcattcaatttccttttggcttgggcaccatcgttacattcatttttcagatgtcaagctagttttctcagaatgtgtgcagggctcgaggccaagtgtggaggccacaggggaggtcacaggtcaagccttctgggagaactgcaagcttgagcctctgataaagtcacgcgattgaattttagccccagtaggttgctgtcgttaaactgtgcacacagggcttcttgcttttaagttagcaggatggaaaaattgcggatgtttgcagcaaatgtgtagaaccagtggcagaagcagccatgctggcccctaagcaatggtattagaaagggttgatgaagattttctcatttgagagttgaacaaaaccaaatggaattctccctagttccgcagcactggtgggtgactctccctgggccggtctcagccctgcagaaaggggcactgtctgcttagcttggtcagcgcagggtctactgcagcagagtgccaggtggatcacagccctcttgtgggggaaggatgggcggagctcccaccttccccacaaatggacacagaatggcacctggtatgtgaggcaggtgcaggtgaccaggagaaggggctgtcagtggttgatggacagctgcctctgctgcctggatgacccaccccctcccctggaccatctcccactttgcctgggtgtcagtcactggagggttagctcagtacaagctggcggatgacctccgtagagcttaggtgaaggggctctcacagggcagtatgtttgagacccttagagggctctctttactcttgcttctcctattatttttaaactgtagtaatacacacgtaacataaagtttaccattttaaagtgtacaattcagtggcatttatcacaatgttgtgcaaccacctctgctctttagttccagaacattttcgctgcccccagaggagaccctgtatttattaagcagtcactccccattcttccctccgcccccagcccccacagtgaaaaatctgttttctctcactttggatttgtctattccggatattccataaagataggatcagacaatatgtgccctttagtgtctggcttatttcatcatcatgttttcagggttcatccctgttgtagtgtgtgtcagtactttgttcatttttgtggctgaatgatattccactgaatggctattttacattttattaatccactcatccactgatggacatttgagttgtttctaccgcatgattaatgtgaatagtgccactgtgaccatatgtgtacaagcttttgtgtagacacttgctttcagctcttttgggtgtatcactaggagtggaattcctgggtcatgtggttattcagtgtttaccgtttttaggaaccacagatgttttccacagtgacagaacattttacattttcaccagcaatgcatgagggttctgattactttcaaaggaaaaaaattaagcagccctgtcaccttgatggtttggtctctggcctcaccgcttcagctcctctggcctgatctcccagggcctgcttttgttcatgtgtgtgtctgtttataccctggctcatcctgtggagggtctgaggctggcaggatcactgggttctgtctccacattggaaggtgagctgtcctaggtcagggtctttgttgcatgcatcgtcctgtccttagcaagagctaccctgtgccatatgggacatacaacaggcacctgttcaggcctggccatgtgggcccacctttggatggtacttgacaaagcctcaaaatgcagtgacaagtttagataaatatgattctgttctgaaatgctgcactggacacagccatccactgcctgccctttacagggctctgtgaagagacagtgaacaatgaagtggaggacgtgtgcaggtggccccagtggtcggtgatggaggagagatttcagcagaccaagcacggagaataaagccaggccagagtgtgctatcagcctgtctgccccctagagctgatggactcagcaaataacagtatagggtacccagttacattcgaatttagacgggtataggattttggtttttcaagatgaaaaaacttatagtggtgagggttgtacaacattatgaatttaataacactgaactgtacactcaaaaatggttaagatagtatattttattgtatgtgtattttaccataataagcaattgaaaaaataagttgtatttcaggtagatagcgaataattttttagtataaatatgttccatgagatgtctggataccgggatgcaggagggactccccttcctcctcccattcacaggcctgcctagagatttgtaagtacagactgactggctgtttttcccagtgtgtcttgtcgtgatacttttaagccacagatccgctttgaaaagatatgatctcccccaggggagtaactattataagaacaaatactctatccaagcttccattctcctcaagataaacatcacaggagtgacctgaattgtaaagaggagtggaaggaaaagaacaataccgtaatgttttctgagccacgcagatgtcaggggacggatccaagggcgtctgaaagaagacgtccacgctgctgagtgagaccttcctctgtgctgctgagtgagaccttccatctgaccagggggtcatgctctcactgctcctgcttggagttctggtgctgtagcgggtctcggccgccccttctgagctgggtggaggaagaagtccctgttgaaatatcagatgagtagggatgatcgcctcttttgaaaacaggagccgtgaagggattcccagagaagattgtcatctaacggagtcattcgtccgcccaggacttctctgtcacagggttacgtttgggagaattttcacaggccactggggatggctgtggctagcctggctttccactgatgccctctatccctaacctcagctcctgacatggctgtcattccagagagtgcttggaagcatcctgactatgttgacgatggcctgagcggagtgagtgtgcactagtttggtgttgtttcatccaaagcaatgtgattatattgctgtactttcagtttcatcaagcaggcaaaatgagaattgacactttttaaaatccaagctttagtttcaccacctggagccaaggtgtttattagaaagatttattggcattagtgtatttttattacaagcatttatctctgtgctgaacagttgcccctgagtcccgtgtgctgtgaagagtctgtgccacaccacacattaattttctgtcctcagagctccggggacacacgctgattctcatgctgtgcctgccgccttctccgagtgatggctgatgtgggtttcaggccccactacagttactcagcgacagatgggaccccgtgtcctctgttggctgtagggagttgaggcgaccctggctggcatcttgttttgaggggtggctggctgctgtactttggggagggcataacaggatttaaatagtatctttatctaggatgcctggagccccaaatccatgtgggcctcccactgtgtgaatttcagatgctgccagccccccaaccccgccacccctgagatggaaattagagcaccagatgggctctcccaaggagaagcatcacaagcccaccctcctgcctctttggaaagtaaccctggctgtttattgtgagatgtggttgtcatggtgacaagtggacacccgcttgggagggagatagaggaaacgctgttatggaggaaaggtcacccctagagacaaccttgtgttgcccgtggacaccccatactatggcctccgtactggggagtcccatgggtagggcatgggggtgcagccatcagtctgtgtccccagccaagccttgagccctggcttgaagttgcatgaaggtacagtggctggcccagccctaacccgtggtggatgcagcccctgttgtgtcccccaacccctgacttatctggccgcctgatgagagtctgtcgccctacatctgtggcgctccctctgcctgacaaattaaatcccgcccagcttgcaggagggatgttgttaacctgatttcatttgctggtgggctggttgatttctttggggtttttttggagatgaccagcacctgtccagcaactagtaaggcagggaaggcctccaggaacccaagtccatgcagaagggcactgtgttggggaactttcagacaagtgggtaaaataccgacgtgtgctatgtgcaccttgaaatagcaaagtgtcctcaacagagctctctgggggatgtcccaaataaggtttactttaggagaatgtgagcggcatctgaggcgagattctcttgttgcatcctttggaagcttttgcttggtgttccttggccatagcaggaagatcagtgccagggatgggtgaggggaagaaaccttgcaggagcggtacctgggccagtctcagccctgcagaaaggggcgctgtctgctccacttggtcagtgcagggtctactgcaacagagtctcgggtggtcacagccctcttgtagggggaaggatgggttttgctcctgggatgctaggcttcgaaaagcagggcagtgtgccagcagtcccagacaaaccagagccgggcctttggtcatgccaggacagcagggtgtggtctggctaggcctgtgagcccctgtggggctcaggggtaggggcagcaggactgggggaggcagggaccaaccagacttcagaactgctgggtcccagctgcacccctgcaccacctcagctctaggaagggcagccccatgtagctttcttgagatgtagcagcagtgctctcccttctccctcgccatccttaaagcccggtgcccgctcccctgcatcccccactcccattgcctctgaaatccggtggtgtctgtgatcctggaggggaggcttagccagcaatcattccaactacctggggcacggcatatctgcccccatcagtgctgggagggtgggcccagatcctttaatttttctcaaaaccccagagaggcagagttccatcaaagagcaagacactgatagactaggacaggggatagggctggcagccatgcctcgtggcatcacctgactccgagagaagccagcccaacacttggggtctcagttttctcacctgtcaagcagggggaagaatattcattgtgtacacaagaggcttttgtaaaccctaaggtgctaggtaaattaggtaaatgtaactttttttttgagactgaatctcactgtgttgcccaggctggagtgcaatggcgccatctcagctcactgcaacctccgcctctcaggctcaagtgattctcctgcctcagcctcccgtgtagctgggattacaggcatccaccaccatgcccggctaattttttgtatttttagtagagacagggtttcaccatgttggccaggctagtctcaaactcctgacctcaactgatctgtctgccttggcctcccaaagtactgggattacaggcgtgagccactgtgcccagctggtaaatgtaacttttatcatcagtgtcttccttgccatcatcatattgttatttctcgataatttatttccagaaagttctggaactggacttaccatgcaggctccggaacctcctctgggaggtggacagggatttaagggctatggatctggcttctgtcttctggatgatataaggaactaaatagagaaaatatacctaaccttaaattttattaattgaagtagaagcagttgtagtttggtgtcttctttaagagaagacttatgacatgtacttggggcattttctatgttgtagtaacagattggctaatttgcatttattctcatccaagaatttaggttttttaaaaatatggcttttaactttttgggcactcttggtgggaacgtaaatagtactactgctgtggaaaacagtatggaaggtccttaaaaactgaaaaatagagttatcctatgatccagtgatttcacctccaggtatgtacgtaaaggaagtggaagtgaagactcaagagatatttgcacacccacgttcatagcagcaccattcacaatagctaagaattggaagcaacccaagtgtccatcaatagatgactggataaacaagaggtggcatgtacacacagtagaatgtgattcagcccttaaaggaaggaaattctgccatgtgcttcaatgtggacgacccttcaggacattttgctgagtgcaataagccagttccaaaagggcacatactgactgcttaatcactccacttacatgaggggcatagagctgcccaattcacagaaacagaaagtagaatggtggttggcaggggctcaggttggggttggggttgggcatattgaggagtttgtttaatgggtacagagttttagttttgggaagaggaagacattctgaaggtggatggtgaccatggttgtacgacagtgtgaatgtacttagtgccactgaactgtacacttaaaaatggtcaaatggtgaactttatgttatgtgcattttactgcaatcaaaagataacaaatttcaaaatgatttaaaataacttttttagaagtatgaaaatagaatattaagtgcatagcagtttaagtataattaaatagacgtctgcacacacacctatacacatacagacatacacatgcattttacaaaattgtatcacattgcatattcaggttttgcatcttgcatttctctaacatataaaatcacgatctttaacttccccgtttccaggtttgcaatggtctggagcagccaaggaagcagcagcgctctgatctcaatggacctgttgacaataacaacattccagaggtaatttttttcaaggatgagagttctgggctggaacactcatctaatgatggagtggcccaccgagttgtggtctgctcactttgtccatgatgttctcatcccacccggtgcctgggggagagggagtccaggtcaggccaagttggtgtcaccatatggtgaggaggtgagggcacactggcctgggaggagggaggagagggcctccctgatgttaggaccatgccatggagtgctcttgtgttgcagatggtgtgtgtgtgggggtgggggaccattggtactacttaattttataaaaagccattctattcattgtctgataaccatgttctaaactagggtttctcaacaatgacaccattaacattgaggcctaggtaatactttgttttggggactgtcctgtgtattgtagttgagcagcatccgtggcctcaacccactagatccttgtacctaccccatccccatccctgatttgtggtaaccaaaaatgtctccagacattgcctaatgatgtccctttgggaacaaaaatcatcccagttgagaaccactgttctaaatcaacaacaggttttaacaaacaatttcctataagctaacagtgctatgatggaagttatttcccctttctggtaacatagtttagatgagattatttaactttgatgaaataacgatggccaccgatggagtggtatccagtctcctttatcttgcttttaaagatgggcctggatggctctcatgccccctggttggagcgtcattgtgttggatggtccctaggctcccttctagtcaagatatgctagtctgagggcccctaagttttagatgatgggcttttgggccactccccaacatcatgttgcctgcagcagactggtttcctgtatggagctgacatcttcagaacaccatcactcatggggggtttgcttttctcattatggctcatatcacagccctgcttagccttcaccttgtgggctacctacttaacaattgttatgtgttttatttttccatatttcctaacagacaaagaaggtggcatcatttccaagttttgtggctggtaagtgactttgaattttatttctcaaggggcagttgcattttacatcaaaataaatggtgcttttagtttgggcattcacctgcaaagcttgtttacaaagcgtgcctacctaccagcaaggtgcttggccattgtctgtttgaacactgtgtagccccacttagtggggaggggaggtccagctgatctgcccgctttgatgcaaggaacagtagacgatctcctttaattataccctcactaattgcatcacagacgacactgatgactgaatagattgagatgtgtctttataagcagctggttatagctaacacttctgatcagggtggatataatgcattcaaattcaggctttttttttttttttagatcctttgtttttctttaccgttccaccctttttgaggaggttaatagtgcatttcaacattcagtaaagaatgaaactggtcgatatgttctgtgtcactcttggggatggggagcacacttgcctggctttgacggagctgagcatctggagaccttgcagggcccctgtaggagatccactgggtttgcttctagtgctccaacctcagagtaaagagcttgttcggcaggatttctgtctttgccaggaggatgtttcctgcccctgctaatgtgttataataaacaatgtgaatttcattaattctttcaataagctggtaattaattcttataaatatttatgggagcaaggtaaattagttttcagaaataaatgactttcagcccttcccatgctgcttttctttttttagcaaacaactaaagcctggggaactgaagcccccaaattcgcctttagagaactagtttgaaccaggctaatccagttccaattggttgaaactggattaactggctcaaatcaattttgactgttataactggcttaatgctgctcagattgggtgagaatctgttttaaaccatcagaattaatatcatgcaattgagatagacttggttccattttgaccaattcagataggctaaaatgggttttgcccagcagtttacatgtggttttaggtacattttatctggttcaaattggttttcttcaggccacagcaggttatgatgattcctggaagagaccacactccccacattcccgcttgtagtgtttgattgggttcctggtttataggagctggcacctcgtgagcagggcgaatgcagtacgtcactgtgccattttccttggcaggcagaagccagggtggggttgccagtcacactgctccagtgaggcagggtctcctggatccaagaagctcacttgtcagtgtatcatagtgtcatctggacagaactctcacactaggaggtgatttagacattaaattccccgacccttgaaccaatctcatatctgcagggagtgggatcgtgagggatcgggaagcagtgtcagtgcctggggtacctcggactctagctcctggcatcccagaagacttggttccctgcaccactcagactgttccaaagcaaatccaaacaaggccggtggcttaaaacaattcagacaggctaaaactgctgtgaccagctagaaccaatgtggaaaacctgaatttatagtttcttctgtaggagagaagccctttgattgttatgaaaacatagaaaactgaagcaaaacaacatcctttactattacagcatttatatgcagcgaggccttcatggaccaaaatcttactcagcaacaggaagagatcatcataatggtgatgccaaaccctagaatataatggatatgggaaaagtttctccaaattaaacaccgttatcagtttgaatgcctttgggtacaagtatcaaaatccccacctaacgttacacaaataggtgtgtgtcttacataaagaagtccagggttggacgtggtggctcacgcctgtaatcccagcactttgggaggccgaggcgggtggatcatgaggtcagcagatcaagaccatcctggccaacatggtgaaaccccgtctgtactaaaatacaaaaaattagccaggcgtgatgctgagcacctatagtcatgctatttgggaggctgaggcaggggaatcgcttgaacccaggaggcggagattgcaatgagccaagatcacaccagtatacgccagcctggcaacagagcgaaactccgtatcaaaaaaaatataaaaaaaatattaaaaagtctagaggtggccaggcacggtggctcatgcctgtaatcccagcactttgggaggccaaggtgggtggatcacaaggtcaggagttcaagaccagcttgaccaatatggtgaaaccctgtctctactaaaaatacaaaaattagccaggcatggtggcgtgtgcctgtagtcccagctacttgggaggctgaggcaggagaatcacttgaacccgggaggcggagcttgcagtgagtcaagatcatgccactgtactccagcctgggcggcagagcaagactccatctcaaaaaaaaaaaaaacaaaacaaaaaacaaaaaaaaaaagtccagaggcaagaggccgccggttcgatggctctgtgatgtcaggattggcgctgttgtgtctcttggcctcctcttcaggcttgtcacctcatcgtcacacagtgtgtgggcagccccagccattgcttctcgttctaggcaggaagaaaaaaggagaagggctgaagtccacaccagctggacgtcctccccttgacattaggaaagcaaaggttttctgtggattaagaggtgatgacttctctgcatgagaatcggaccctctgttacctttcatagtgtgctccctgggtaacctgaaaggcagcgtgtcagctgtgtctccaggcaacattgcttatggtgagatgctctttttgataaactgtatctagatgggaaaattctaatgcttgcggggcagggcatccagggctttgagcttctcacagtggtgactttcgtgactggcatgtctcttgaaggtgaccctggaagctatgccccacccatggggtgattgtgagagatactggctgctgggagcatgaggctcttagaccagatgggttccacatgcccttcttggtgggagttttgtacccttgcagctgacccatccagggagttctgtaccattgcagctgacccatccaggggcccatgagactagctgtgtgggtgcagtgtggactcccatcagagagtccaggaggcaaactggcgtctgtcttgttcccttggagtagacggccccatgtctagctgagccttaggacactgcatgcttctgaatatctagttgaaccttacttagaagacccagaagcctcttcgacacactgcttatttctttgtggccagagctgtgtcacatgaccagcctctcagatgttagtgttggccagacaatcaaaccctgggctttttatgaaggcagggcaggtctggaatcagccctgggtgcctgccgccacttcccatcccactgcgggcccttccagcctcctggcgtgtccagtgctgaggctgagtatgtgagttcctgggaagcccctgtgtaagggaggagcagctcctccaccctatttgtgtctgagaagttgccctgaagggaaatgttcctggagtattcatgagtatttggtctcagcttatgccttatttcatatcagataattgttgataataatgaaaaaaataatagtaacaatgcacatgataccgtctgaaccctcgttggggcctggtgtccactccctgtgccatgcagcatctctctatttcatgtcgcctggtcaaccaccacgtgaggagtaagtactttcccccgtctgataggttagaaaactgatgcacagtgaggctaaagtcacttgtgtgcagtcccatggctgtgcgggggacagagcctggacttggacccatgtcttggtgcttgacacataaactcgtagccgaggtcattcctccctacccagcatgccttcatataccaggaataggtaagacctgtcaggtgctttctttgagccaggcccagatctaagtgttttaagtatatcaacttaacaatcactatatccacagctcagggagagtgaatcccgggccgaaggtcaccaggtagcaagtggcagagttaggattcgaaccagtctggaatctgagctcatcaccacactgcactgcctggcgaccctcacgcagtgggtgaggaagaaccttcacttagagaagacctaccatgcaggtgccagagagttcagtggaggggagcgttccagatgccagagctcctggccttgtcaggcgcaggatcacagccttctctcagcagaggcattgtgaggaagggcctgccacaatcactgtctgtggaaagttctcggggtctagcgaccctctcagactgggaaggttaacgctgcagagaaaacctccttatgaaagtgcggattgcacagaggatgcactgcctgtcctgcggggaggaatccgaaagcagccaccctcaagatgtcccctcctacaggacgtggtgtctggcagcagcttgagcccaagctgcttagagggtcactgcctctggatgagtatatgtgaatgaccagcttttctatacaggtaaacacgtgctcattaaaaccaaaaggctgatgttagtcccaagcaatggggcctaacagtggcagcttcagtacaaaataacaaagactggtaaatcttactctgctttttgtactttgttctcctcatccaaagctcatacaggatgttttgaaacccaccaccccaccagcagcttgaggcttatgccaaaatgctgccaggccttagggtcctggggtcctttacagcctgtctatagctcatcaacttgcccagctccgtgtggatcatgtggaaggcatggagattacatgccccagacctggagctgagctcacctatcaccccttccttctctcaggggtcctcacagtggtaaagctgctttgttggtttcatacagtgggcacatgggatctgagacttagtttgctcttaaaataggcagttggggtgaacctgttcagataagactcttaaagtgaagacatctcccacctcctcctctttggtgtatttgggtgggggatggacgggaggaaggtcaccctgtgggaccagaggggatgtggcgcattccaaagaggagttatggaaacccagatgactttcctttttctacaaacaagatcatgtttctcctgtactacatgcagtcagcaggaatagggattcgtcgttttaaaatctgaacttttattcactaagtagaagttgttaaagatttctcagaatagtgcttgtatcagaccaagagctgcaagagttaaaaatgagaaatccccacagtacctcttgttctgcctatacatcccagatccctagtccttctgtatagtggaagccacttacatttcttgtgaatttctccaggaatttctcagctcatccataggcccttttccttaaatagacattgcactggccacatggctctgtacttagctttttcctttcttgctagatcttggaaacagcaataggtccacctgattatttaagcggcagcacaggatcggttgagtggatgtgggatggggtattaaccagcccccttggactgattgttgggagatttccagtcagtgcagcagtgaacagccttgtggctacgcctttgtgtttgggtgtgggttcttttatggaggcggttcctggctatggcaggggtacaggccaggagcacagcaactctgatagacacgggcagaatgccttcccaaggggggacagcgtacgctgctgttggtcatgtatgagagttggttacgtatgaggttcccacactgttaccaacactgcatgaccggctgtttgatataagctccaggccgatgggtgcaaagaggtgtcttgttgatttcacgtgtctttcataataagtgaagccaaacactatttcgtatgttcataggtggtttttcttttcagtgcactgccagtttgtttcctgtgctcattcctctgttagattttcacccccagctttattggcgtataactgacaaataaaagttttgtatattaagtcatacaatgtaatgtattgatataagtttacatggtgaaatgactaccacagccaagcgcattaacatagccatcacttcacatagctacctttttgtgtgtgtggtgagaacacttcagatcgattgtcttagcagattactagtatacaatacaggattattaactacagacatttactcatctcataactaaaggtttgtaccatttgaccaatatctccccatttcccccacccctcagcccctggcaattgggaatttgggtgtttcttattgatttgtattattctttacatataaaggaaatgaaccctttggtttgtactgtaaaagtttaccccagcttaccattcttttcttcttcttctttttttggtatgctttttactttgctaaacatgtcatttagtcaaatatatcagtctttttcctttgagcttactgagtttttgaggttagtgtgaccatcacactcctaagattatttttgaaaataaagttgttggccaggcacagtggctcatgcctgtaatcccagcactttgggaggccaaggtgggcaggtcacctgaggtcaggagttcaagaccaggttgggcaacatggtgaaactccgtctctactaacagtacaaaaaataaactgagcgcagcagcacgtgcctgtaatcccagctactagagaggctggggcaggagaattgcttgaatctgggagttagaggttgcagtgagccgagatcgtgccacagtgctccagcctgggcaacagagtgagacaccgtctcaaaaaaaaaaattaattgattaattagttaaataaaaagctgtcttccaggactttggtattattttaaattatttaaataattgatttatctggaatttatcttggtgtatttatacaggaaaagttacattttaggcattttgtcccaatagctagccagttatgccagaactatccaaggaatctttcccttgcaagtttgaaatgctgcctttaccgtacccaaatcgtcatgtgggtctcggtctgtttctggatctgttacagggacggtccattcaggttccagatccaggctgctttatttactggggatttatggtgcattttattacctggtagggctactttcagaccttgccaccatcattccatttcagatttttttcctaggtatttttgcacttttatttttccatagtaactttaaaactagcttgtctggttattcactgcaaactcttttgtttgttttgttttgttttgagacagagtctcactctgtcgcccaggctggagtgcaatggcgcaatcttggctcactgcaaccttcgccttctgggttcaagcgattctcctgtctcatcctcccgagtagctggaattacaggggtgcaccaccatggccggctaatttttgtatttttagtagagatggggttttgccatgttggtcaagctggtcttgaactcctgacctcaggtaacccatccacctcagcctcccaaagtgctgggattacaggcatgagccaccgcgcccgggccactacaaactcttactggtatttttattaggcatgcttaaagtctgtccatttaggggaaaaaatgtcagctttacaacatagtctttctagccaacaaaggatttatctgtccacttgttcaagctcatttatcttcatcggtaaagttttttcataaaaattcaacacatatcttgtttgtctgtttcttgttgttttatcccttttattgtttttgtaaatgctgactttcattatttttcaacatgttgctgtttgtaggtacaaagaaagctatcgatttttatatattaaatttgaaaccattgccttagtgaattctcttattttttaaaaatagatttttagttgttttcttgagtttttcctggcatgcaatcataccatctgcaaacaagaatgatttttgctgcttcctttcttgttttctattacttcttcttgcttaatcagattgggtagaacagaaggaacaattttacataatagtagaatatggcttcctaaaaataacacctttttgaaagatctatgcttttaattttgtcataaaaacttcaagcatatgaaaaaatagcttcagtatttacccattcatggctagtggtatttaatctacaccctgaccctttcccagattattctaaagcaaatctcagatcttacatcatagcctctttaaatatttcatattgtatctctaaaatataggagttctgtttttaaaaataatttcaatgctgttatcacaactaaagttaatatttgtttatgccattaaatatttgtttttgtttgcattttcccagtttacagggcgctgtttgaatggggatccaaacaaaacccgtctattgagattggtcaatgcatttcataattcttttatgtctcttttaggttgtccatccgtctcttttttctgtcttacaaatttttgttggtgttattgtggaagaatctgtcatttatcctgtagattttcctgcagtgtggattttgctgattgcatcttcatggtgttgtttaatgtgttcctctattctctgtgtcctgtaaaatagtggttgtttttagacatagaggcttgatcagattcagtttgattgggcaaaaactttcgtacatatttttgtgttgttctattgaggcacataatatctggtcatctcttttttggtgatattagcaaccattaatgatcattgtctagatctagtaattgattagaagttgccaaatggtggtgttctaatttcatcatttcttcttcattagttagctggaattcttctatgtagagaaactttccctcaagtatttggttaccctgaatattgttcatataagaaaagcagattaaatgcttgatttcttctcttttttgaaaaatttaaaaattaatgagttggctgggcgcagtggctcatgcctgtaatcccagcactttgggaggctaagacgggtggatcacaaggtcaggagatcaagaccatcctggctaacacagtgaaaccccgtctctactaaaaatacaaaaaattagccaggcgtggtggcgggcgcctatagtcccagctactcaggaggctgagacaggagaatggcgtgaacccgggaggcggagcttgcagtgagccgagattgcaccactgcactccagcctgggcgacagagtaagactccatctcaaaaaaaaaaaaaaaaaaaaaattaatgagtttccccgacagcctttaaaagataaccggtgaggttgtgtatgttgttgttagcacagttgatgtgttttgtgtgtgttaccatgattattggtgctcaagttttctatggccaataagagcttctttaggttgttttctgagtcccgtcaatgtgaacccagtagtctttgattgtttcctttctttctggtatattccaggatcatcttaaatatttcttgccccaggtctggaaccagttggttctttctccatggagccctgtgaaataacatttagagactgtaatctgggtagtgtggttgctcgttgttgtagatttggtgagagtgtatatgtctatgtggaaggcgcctcctaaatggcccccaaggacccctgcctcttggtattcatggctgtgagtccttccctccccctgtgtgggggatggacttactgagctgcttctattgaatagaatatggtagaagagatgggatatggcttccaagatcaggttacaaagagatgtggcttctgtctcagcttgtcctttcttgttctctcttacttgttccctctgaaggaaccaagctagcctggtgtggttggcagttgccccatccagaggcccacgtggcacaggactgatgtttctggccagcggcctggtgagagaacttggaagtggatgctcccctcttcaggcattcagatggctgcagcatcactgagtaccttgctgcctgtgacagacgagaggtcctgagccaaagtcacccagctaagccacacccagattcccgatccacagaaactctcagataatccacggttgttgttttgagccactaaattcccgagtaatttgttatgcagccaacaataactaatacacaacatattttttaagatcaaataacgtcatgattcctaatgatactttgtcaggtttataggttctaacatttgtagtttctttttcctgtgccccaaattcctgttctcaaggacaccagcataattttgcattggttttattccattaagcttacagcagtctcagaataacaataccaaacactgccaaggacacatgattgtagatacagattatgatttatttgcatttacttttgtgtttagaatacatcccacaagggatgtacagtcagacaactgtgttttaaaatattttggaatagatcacaactggatacacttttagattcattggtttcatttttctcttagttatttggactttgctttttccatttaattttgttttataattatataaaataattacatggtatgaaattcaaataaacaacacaggatgtatgcaaagaggtcagtttcttcccctatttatccccccacctcccaatttcttcccttccactataggtaaccattttgagcattttacatatttttattgtaagcatgtcttcccctttcttaggtaaatggtagtggattagactcccatatctccatcttgccttcttcacttcacactaaaccctggcggtgatgccacagctctgtgctgttcacaggagcatggagaggatgttctgcagaactccactgtgtggatagatgtctcctgttcaggagtgtttgggtggtttccaggtttttgctattacaaatagtgctgctgcagtgaaccgcctatgcatatgctttttcccatttttgccatttttttttaaaaaaaattatttattatgctttttctgggaagtcattctccccactgcaagggttaggatctgtcttgggcaactctgtgcgttttcttgagcttggctttgaccttccttccctgactctctgttgtggcttctcttcctcccagcatccagtgacttaatcttgctcattgggtgtctaaagttcaacactgtggaacccccaaatcccttttatcagtgacaaagcctgtgctgcaggcccaggtgtggccactccctggtgaatgtcccataggtgtgattttcagatggtgtcttctctttcgtatcagccatattatagggtcaccttcagtgggggcatctcaaggcacaggccctggcagtactggagagtcgggcctggaggccacgccttagctctgcagcagaaggtctcacttgagacgccagttacacgactctgatactcacccactcctgcctcctttccccactccagacctagggggcacttcagggggcaggctctcctgctgatctggtggctcgcctcctcccagtcctgtcctgccccattagagctgcagcccctcctcccagttgaggccaggtcccgtctgcactttggaacctcacacgatctgatgtcgtttgtctcctgtcccttttgctcgcccctccactggcttttgaccacgtctgtcccaccctgcatctatccacaccaccccgctctacctgccccttttctttcacagccggaatctgggagtggcagcctcattgtctgcacctcccctgcacctctcagccccctctctggctcctgccccggttcctctgaaacagctctttgaggtcacgactgacttccttgacactgtgcccaatacacgaggtctccttgtagttggcctcctgctagcatgggtgtagatgggcaggcctccctttctaagccccttcttttcttggtacttagcagagcagagtcctggggcttcatcctgcccccttgcccatgaccttccttgcagactcatccatgcctgcagcttcacttggcacctgcagatggttcattcccaaatctgtttttctaaccgggactcccgagtccagccgcctactgagcatccaggctcctgccactaaacttgcctggaatccccaacccaagctcagtcctcttccaggcaccctttctcagtgaggggcaggtctgtccatcgagctctgcaaccattgtctagcgtcctcatcttctctcagactccagtccacctttccgtcctgttgatggacccctaaatccccatctgttgctgtctctccatttccgttgtcaccctgtccgtaccatcatcaccactcatgtgctgggatggctacagtagcctctcagctgctctcccttcttcctctctgctgcctgcccctctgccagagttcatttctaatgaaggagtggttgggccacttccctgatggataccctggagtgacagtccttatggcctgtcacccgtggccccagggtcctcacatctggccagcgcttcctccccaccctcgacttgtctcagctgctggcccatgccctaggcctcggcagtccagacatcctatagatcttctaaggtgtcattgtctctgcaccctagggcctttgcacctgctcccgcctcagcctgggaggctttctcctccttttgccttatggcttgttgattccttctcctcctccagacctcagcttaaacagcagccacccccaaattcctcaccagagcagcctccctgtcccttccttcccagggccatagcctcccttttgagcattcaccatggcccatcctgatgcatttgttctgtggctgtgggactgatgtcagcctcactgtgtagcctgtgagctccatgtttctgtcttaacaccggtctttatacagtgggttcagaaatgctgagcacctgaactcatgacagtgaacttgggcaaagccacgtgacccacttagatggtccttatttgtaaaattgggaccctgagattgcttcatggcgtggttgaggactgggtggaactgtaccattgttgcacagaggtctggtgtgttgggcatgagggctgcactccaagactccgtgcctttgcagagagcagcgggccttgtggatgcacccccacactcccacatacacctgtgctccagctccacccagccacctcctcccagacccccaggatatacagggacaggtcttggagctaatgagaccccctggggccacactggcaccttagaagcctctgtccaccacccatgttcaggataattttcttcaaaggtggcaggagtggagaccctcaggcttgaagctgtgggactcccctccccttccctctccagagggcctagggttttcctaagcggtgtttcaaacagaggcttcctctggcaggggagaacctggagcgccttattcttctccagactgtgcagatacactgtgcatatgcctatgtgagtaagatatacggtgtgaaaaggataaatcactctctggggagacaagatctttaaacctgtatcttgattatcttgtcattttgtctccctctggtggtctcagcttagggtcagtgcaagacttgagcaaaataacagcaatttctacccaaacatgtagggctagctgctttcattttctaacgaagctgttagatttgggttctgcgtttcctgcggaagttgagagctgtgcccatgaatctgatatactccccacaccatgccgcccccactggactcttctctgggtctgggttctcctcccgtggtgcgtgtgagtgggaggcaggatgctggggccaccttggactcgattgtttctcgctgaacaaaagagcaaggcaggcatggaaggcccccaggcagaggtgggtggtggctggagttgcagcaaggcccttgagtgcttcactggcctcatcccggaagcaggcatccgtgggtgccagtggtgaccccctgcctgggatggggcatccttcacacacagcagtctgtgcccagatgggccccagagctactgacgctcacttcagggggagacgaggccagtctttcccaaatctactcaaggacatgggtcaacatggaaatgtgaacctcagaagggtctggtgcactgaccagggccaccctgggggctggcgagggagaagccaaggggcagtgcctagaaaggtaggagtcagattccaaagggagggctggcctcccagcctccccagggcctggggctgacagggtgccaggcagcccctgccacagaggggacataaggacactcgcccaaggccctgctcacctgctggggctgtgaggctggggtacctggggcgcctggaagaaccagagctttcctgcagaacaaagtgacgccatctagtggtcaatgagagccactgcattgggccccactgggtgactggggcttcactggggggtgcctgttgagccatgctcactggggacggcaaggtggtgtgaggtagtagaaacaggcctacctcaggcgctgggagccttcccagccccacagccagatgccataaaaggcagcacagggcatgtctggcgagcctgtggcagccagggctgtcatacacgctctccaagccccccagctaggcagatgtgcacacttcactctgaagaagcgccagggtatggtgggggtactgcattgggatagatgggtcctgttccctctgtggggctgcctctgattctcctggtgacaggagaatcccggtgtaccctctgagagacaggtggacaggggttcctcccctggtgccacccctgaatcccgcagtcccccacattggtgcctgcagccctgcccagctgggagaaggtttatcggctccagggcaaggggtgaatggaggatatttaaaagccgtgggaggaccccattgataggactcagttagatgcacaggggagggatgggggtccctgtggggagagacggctgggagcacaggtgatcctctgaccccaggggcacgcagacccactactgcccaggaaagcaggaaggagggccaagtgggctgagcaccaacgcgaagctccccacttggtctgtctgagcaggtgagggaggggcagccaggagtttgaggcagtggaggggtctggaataactcttgcatggaggaagagtctgagtttcccagagagatagatgagagttgtgaggttgtttggggggcatttggggtcaagaatttataatacatttatcatggcactcatttgccctcttgggcagctttttccagcctcaggtccagagaaaacaggttggagatttgctgaactcctgtgggcagatacacaggactggggtcagggaactgaggatactgggcggatgttattgaagtggtggatggcagcgcccaagctgggccagttgatgattttagcaacagaatgggttagaggtgagaccagggatcagctggctgagggagggaagaggtcaggaggttgctggcgcgagggctggggaagtgcaggatggctgggcccgtgatgctggagggactcagggaggggccagctggagcaggaggggagccaggaagccagggccaaaatccccagtggaaggggctctggccaggaggtgggcagtcgggagggataaagcaggtgacatggccaacatgggtctgagaggacagccaagccacggtctaggatagctcagaggtcggctgactgcagccccaatcgcaaatcctcctggccccctgattttgcatataaagtttccttggcacacagccacacctcctgttttacatactgtctacggctacctttacgcctcaggtacaacggtgaatagttgcaacagagaccacaaagcctaaaacacgtaccatctccccctttacaggaaaggtttgcccacccctagctggagccttattgtctggcataggagccactcaagattggtttgtgggcaacatggacaggacttgggggttggttggatatgactctaacatgtggctctttatatttcaattaattaaaattacatacaagaaatgggtccagtccctcagctgcaggagcctcagtgccagtgctcaaagccacatgtgggtagcggatcctgtattggacactgcagagatagaaccttccattgtggctggcaggaagtttgttgggtcacgatggtctaggggcagcagatggaacaagcatgatgttgccaagcctgggcctgcggtgtgatgggtgtgaggagctacacgggtgtcctgagaggctacagacaggcaggagcccctcaggacagatgcacaaggacaggccaaggagaagcccagggcacagtttcaggtcaccagcatgagttccggggctgtggggaaggcatggaaagtgctgttgtgtttgggatgtgacgccttctggatttgcagcctgtgattgtcatcttgagtgacagtcaactggaatgctggcattgtcctcctgacactgtttgtgcagagttttctggcccaagtgttgatttcgcgcagttacttgcagcacggggtagtgagggaagcagaccggccgcccgtggctggctgcagatggcaatggttgggcccttctagtttgccccgcatcctggctgccgtgttccttgtgctatggccaggcatgcaagttctttgttcaggggacttctcctctaggaagactctgactctgtgccctccttcagttccagggccctgcgaaccagaagacctcatcgacgggatcatctttgctgccaattacctggggtccacccagctgctatcagaacggaacccttccaaaaacatcagaatgatgcaagcgcaggaggccgtcagccgggtcaaggtagaggtgcttcgagggcccctcgcggatgcccgcacactttggggggcactagcaggagggaatatggcggggcgtaggccctcttccagctcggactgcacagccctcagcacagggggcaggagcggcccaggtgccaacgaggctgagggaggcttgcgccttggctgggagaaagctggctgggcagaggcaaccagctccttaacaagaggcccacggaatcccagaaatacgacctttaaagatcatcgttccaaagcattctagtcatcaaacaatcccaaatcccagttcaacagtatgtgtatttttagtgccattcagagtgcttcaagaaagggtgaaaaataaatcacgttttatttaaattcaggacctcaagaaaaactttgacctgcttgtagctctaagtgctcattggattgtctggttttgaacatcgggtgaggccgggcaaggggaagatgaggccacgtcagcaaaattaaatggggtcggcggggaggggatgcagccatctgaggtctcagctctctgagcaagacaggatctgcagaggcccgccagcccaggggtgagaaatggcagcaacctcctccccagccctcaccatacacaacctcctctaacagaagcagagaagcaccatgaggccatccggggtgggcaggagaaagccaggtaacccagggcagtgctgagccctgctggccagtgcctctcagcagaggcccggccctcccatcccagacccttgccttgctccgctgcctggagctcagctccccttcctgccggctgatggcatctttcctgtcctccatagatggggtggttggcagtcatttctagcgctccagggacacctgtgtgggcttctcttggtcagtgtgtgtgcttgaagtgggcaatggctgtccacccgtccctgctgggctttgctaggcaccagacctgagagtgggggcatcaaccaccaaagtgacataacctcacgcaccttccttctctctgtgccaacttgtttttcttttctcttccatgctgtcagaggatgcaaaaggctgctaagatcaagaaaaaagcggtgtgtagggccttgaggccctgggacagtgttgtttgcttgtgtttccgtggcttgtcctgggcagtgggggctggggggttcccctggggatctaaataatgttgcaaagcagcttttcctcttcccttggtaggtgaatcttagatgtttgtaaatgaaactacagacacttcatttttttaaccacccatttatggaaggatttattaattcttctttcttagcatctcctgtgtactgtatggataatgctgtgatgttcctgttttacgtggacattttaaattgatatgacatttagttgatatgacaacgtggtgggtgtagggtctgggcctcctgtgcagtattactgaattgttctgatagttaaagattccttaagcttaatttactaagtcaggagggtgagtagctcagtttgcccgtgtggtgctttctttattggaaatgagtttttgggctgggtgctgtggctcacacatgtaatcccagcactttgggagacagaggcaggaggatcatttgagcctaggagtttgagattggcctgggcaacacaatgagaaccctgtctccacaactttttttttttttttaattagctggtcatgatggcacatgcctgaagtcccagctgcctgggaggctgaagtgggaggagcacttgagcctgggagtttgaggctgcagtgatctgtgtttgcaccactgcactccagcctgggcgacagagtgagaccctatctcttaaagaaaaaaaaaagaaacaaaaaaagaaaataagtgttgaaacactggcagacttttaaaaatgggttgacactgaggccgggcgccgtggctcacgcctgtaatcccagcactttgggaggccgaggcgggcggatcacctgaggtcgggagttcgagattagcctgaccaacatggagaaaccccgtctctactaaaaatacaaaaaattagccaggcatggtggtacatgcctgtaattccagatactcgggaggctgaggcaggagaatcacttgaactcgggaggcaagaggtcgcagtgagccgagatcatgccattgcactccagcctgggcaacacgagcgaaactccatctcaaaagaaaaaaaaaaaggattgacatcgagtcatttgtttgtcacctggtcatttagtaaatgctagagcttttccaatcctcctcatacagaaaatatcaaaatagttggtgtcacaaggcctggggcaaaccccggggtccttggcactggcttattgcccactgttttcttctgtttaaacagcaggagatttagttccccctccctgctttgaagtaatgccattttctggcgctttggccagaagacccatgtggggactccctcttctggagtgagactttggtccacctaggatgtctgccttttgcccagcagcgtctcctttgattctgctcaggagcaggagaggaaggatcatgctcatgctcctcttcccgggctgatttcctccaggcaaggcagaatgtgccacacattgcagacttgcagttggggtgtgcttttctcaaaagagaggggccctcgcttgcagcctcctagtccagctggagcagggagtccctacggactgcagctggcttctgggacctgcaggtccagcaatcctacagagtcgctgccgcctttagaggggttggtacaggcagacccagctcaaaaaggcctctgcggccagtcaggtggccgcctgattacatttaattacggtttgttcttcctttttggaaagtgggatgctcagtgtcattgctgaaggtccctttcctggcccggccacagccatggggatgactgcaggtcatgccccccatccacagacatgccgaggcccaccctgtggcctgttctctggtgtctgtaggatccgtactgtcgacaccctcccttcttctgccaaggaggatgatgggtgtcctctccctgccctgttactgatgggttttccactggaggctgggtggcttcaggctgcccctcttctcccatccagggatcccagcctcaggtttcctccacaattgtcactaatgccaaggtccacctgcaacttttctcacttctggcttgacctactttttagcaagaggattttgagccacaacccatgaatataacctttaaatgcatgctgatgctgaatataacccaattttaaaaaacagaaaaagttcctccgcggctgcggattgtcagctgcactgctttcaactcctttctctttctaatgagttaaaagcaaagaaagcccaaaagaccctttcccttgaaaattgagctaaaatacacatttattattacaataccgggcctctctaaaactcaaaattcttgaggaattgtcagcagggagatttcttatttcagattttctagtgaataattaaatcatagtttttgctgtttcgaaatggaaaatagaccaccctgggctccccagtgaccacggagaattattcacctcggtgggcaaaccaatagaacttgaaattcattgccaccgtgcagtggtaattaggattcttacaaatgtaaaaaccaattaaaggctatcctagtttggggcagactctgaagagttcactcagctcagaagagcccatgaaactcgtctcacaaccatatgccagacatactacagtggctacaggtgacgaattaggccatttgtgtggcacctctcttggcttctctctgtcgctgtgaggacagcacttaggccagccccagggctcagtcccccaaggacgctgtgggatggacatggtggtgactgattaaatcagaaggaaaggctgacattttcattcagcttctctgacaatgtcttccccatttcttaaggatacttagaatcccaaatccaggaaacgtaacctgagtctataaattccacaggggtcagccagagggccttgcttgccactggcaggaggggctgtggcgacagacccaggcgtcccgccccatctcggtcaagctcccgggggctggccctcctccctcccaggtgcctcttacagactgcctcgagaactcacacttagctagatgatgcggccggtggcgtgcaggtagatttctgatggccagtagcatttccttctacgtggactctgggtaattgttaaaattgccgagccttccttcgagttattactttttacattgacggataaaattgtatgtatttgttatgtacaacataatattttggagcatatacacattgtgaaatgactatatctagctaattaacgtgcattacatcacctagttttaatttttgtaatgagaacacttcattcactatcttagcaatttttaagaatatgaaatattattaacggtagtcaccatgatgcacaatagatctcttgaactcatttctcctgtctagcaggagctttgtgtccgtggaccaatacttcccccttcactcctttgccccagcccctgataaccaccattcagctctctacttctgtgagatcgacatttgtagcttccacctgagtgagatggtgcagtatttatctttctgtgcctggctgatttcacttcacagcatgtcctctagggtcatccatgtgttggaaatgacatggctttttctttgtgaaggctgagtaggcctccagtgtgtctgcgcgccacatttctttatccattcatcgtgaatggacttcgggttgatcccatgtcttggctgttgtggatagtgctgccgtgagcatgggagtgcaggtgtctcctagacacgctgatttcacttcctttggaaatatgcccagcagtgggattgctggatcacatggtggttgtagtttgaatttttggaggaaccgccattctattctccacagtggctgcactgattcacaccctcccacagtgtaccagggttcccttttctccaccccacgccagtgcttcttatcttttatctttttgacgagagccattctgacagatatgaaatgatatattgttgtggttttaatttggatttatctggtgattagggatgttgagcattttgtcataatgctatttgcatgtcctctattccgagttggtttttggactttaacaatatccactgtccttcttagaattctgagggggatgcccagacgctgacggaagtggacctcttcatttccacccagaggatcaaggttttaaatgcagacacgcaggtaagcgtttaagacagttgttcaaaatcaggtaaactcctaagttcgactccttcttgtcccatggtataggccctcgttctcagcagcttctctcctgtgctctctgcgcccatcaacccaaggcccatagcccgggctgcgggaggagcaaggagcgcacagcaggtagcagtcgtgctggcgtcaccccagggctctgcgggcgggaggtaggtgggaagacctgctgggctacctgggccctcccctgcttccccactcccgggtagcctgacctctggggacagaggaggcagcagcccccactatgtggctcacactgcagcccaccactcccaacccagtgccgtgccctgaccatcctccaggccctcacataccctgatacgggcacaggggcgcccttcctcatcccatgtctgtcctgtgtccaggcttgcaccttgtcccactgatctttgtgtcctgcacccccctaccctggaaccagccccctcctggagcctggcacttggtgaaaactcagggagacaggtgccagggctcaggcactgggcttgcgacgcttcacagactttgacttcattttctgatcttttgtgggcaaaccatctggactagatccccccaccaaccctccgagccccatgcctcatcacccacctgtgctgggtgtccccaagaccaccacaggctgggtggtttggaggactgacaggactcagtgagctcacagctgagatttatttcagcagatggctccagagcagaatcagcaaagcggatgcaggcttccagagccctccccgcagtcacacaggacacactgaactccctggcaaggggctgtgacaacagagaagttgtgtctaccagggaagctcatagacactcagcccaaggtgtttactgggagttggtcataggcaccctctgcctggcagctaccaaaattccagactcccagaggcaaaagaggtgtccagcctagaccacgttgtttgcacaaacggtttaggcaaaaggaaccatggttgtcagttcgggtgctgggtaccctcctgagatccacgttcccagatgccagagagggccagccttgcaggcgggcctttctgggtacagctgctaggcctgccccagtacctcttcttgccagtgtacatggagggtgccacacctggggtgggaggatgggcttggggattgaagctgagccccatcctcatgagctgtatagccttaaacaagttcctgaacatctctgaacctcctaatacccacagccccagctgaaagagtaactcttccgctggatcctgtgaaggagagatgagaaatctcctaggctggcccagttcagggttcactccactggccccttctcccttcctttcctttcccttctggatctttggattctggacagggcatgcaaattaaagctgttggggcagaggagctggagaggagggaacaggtgagagactgggaaggccaaagtagccattcagagcaggagagcagatgcggccatgttggtaggcagcctctgtgaggaggaggagggatctgccattgataggagctggggaaggaacatgtttctgacacctggggattgattcaggcatttatgacagtgacagaaatcaggagatgctgaagagccactccaactgtttcctttcagtgtccctccctggaaggtgactcttgtggttatgaaacagcctcatggctttggccagaaaaaaagtcagcagctgagacaaaggtgaagcagcatgcactgcaaagtggattctgtgaggaagaaatgaggtccagaggttgcagaaacactcgagtttcttttgtgaacagaggacaaaagcataaaagaccagttgattagtttttttgagctttgtgtgcagtcttgttaggtaggggttgtgggcaagatgctggctggagattcctgtccaaggacaaaaaaccatcaagagtcatgggcctgccagaggccgagggaattgaagtcaggtgggctaccttggtgtcttttgacccaggcccaggctgtttgggctccctgggaagagctcattgaatgacaaacattggccttgatgctttcctcttctgcacagcaggaaggccaggccaggccactcttgggcccataggagagcacctcgttcagaagggacccttctccagagccactggtggcctctcatccgggaatgtatgggtttcactatatggcaagcccctgctccagcagagacagcccgagagctcacctgacatcacgcctccctgggttctgcacagtccattttggaagctgggactgagatgagggcagagtgactttgactgtaaatcattaccctaaaacgctctgttaattagggccgtggttctcaaccagtgtgatttttgtccctcaggggacatttagcaatggctggaaataattttcattctcacacttgggaagagggaggtgctactggcatctcctggggagaggcttggaatgctcctaacaccttgcagtgcacatgacagccctccacaataaagaatgatccggccccaaatgtcaggagaatcagggttgcgaaacccgaataattggagtgccttttttttttttttcctttctttttttttgagacggagttttgctcttgttgcccaggctggagtgcagtggcgcaatctcggctcgatgcaacctctgccttcacagttcaagcgattctcctgcctcagcctcctgagtatctgggattacaggcacctgccaccacgcccaactatttattttatatttttagtagagatggggtttcaccatgtttgccaggctggtcttgaactcctgacctcaggtgatctgcctgcctcggcctcccaaagtgctaggattacaggcttgagccaccatgcccagccctggagtacttttcaatggattgtcccagtagtgttccctgacgtggcactgtctccctcccgacaggaaaccatgatggaccacgccttgcgtaccatctcctacatcgccgacattgggaacattgtagtgctgatggccagacgccgcatgccccggtcagcctctcaggactgcatcgagaccacgcccggggcccaggaaggcaagaagcagtataagatgatctgccatgtgttcgagtcggaggatgtaagtaagcccttgccagggcactcccctcccaaagttcacagcccagggcggctccaggatccaggcgctgtggaaaccaccctcaggtggaaagcctccatgctgttactgatgtttccagtggatcagtgatcttttgcatactctttgggtttgcaaagatagtgaatacagttttattctacttcttgaaataggttcttcaggagctgtttataaattgagttgtggttaaatatatgagggagctatttgaagaaatccctttacaaaacattttctctactaaaaatgaagttaatctttgcataacttttgttattaaaatgcaaattttcgcatggccctggcatgctgtataaagaaagcacatctgcacatgaggcttagttctgcctttgcgtgtggtcttcagaggaagtaaaaagtgattctgaagtataagataccaaagactcaggaaaagatcacaagccctttggctccctccttggctggagaagagtgttgtttttagcctggagggggacagaggggctgaggaaggagcagcagggccaagaggggagctcagagaggaactgtccttcctggaggctgatcttactcacagaccagcagggggcgctgctggtgagccagttttgtggctgttgccagagtgaaattttaaaatatgatctatggctgggcacggtagttcatgcctgtaatcccaacacttttgggaggctgaggtgcgtggatcacctgaggtcaggagttcaaaaccagcctggccaacattgcgaaaccctagtctctactaaagatacaaaaaaattagccaagcttggtggtgcgtgcctgtaatcccagctacgtgggaggctgaggcaggagaattgcttgaacctgggaggcggagattgcagtgagctgagatcgtgccattgcactccagcctgggtgacaagagtgaaactccgtctcaaaaaaaaaaaaaaatctatccttcaggggcagttggccagggcgttctttttcacataaggacttgaggctgtctcagggacctgggcaatagggaagggtccccatattgtcatgatcctgacatacagcatggaaactgaagacagggttcaaacctttggctggcgcagtcatcttcttcctaagaacttgggtccacttgaagtgcttcggcgcaatggcagatttacaggagggagagagcatttcaacagcgcactcacacattccttccaccgctacacggagacccttcgaaacctggatgggtatttctgtgtgactgagggccgaggatgtgtgagagacctggcttggggatgggccacaggtactggcggaatgaggccaggagcaggcccggtggcgaagggtggcagtcagctggtgagagtttccaaggggcactgagagcccccaggtgcagccgatgcggagggttaaagccagggtatgccgtattgggtagatgaggccgcagggtggtcctgccagcaacagcagcctcctcttccccacctctccagcgcctgcaggctctgcccacagcccacttgcaggaggccgcttgagccctgaggtggggcctgggctgggctcctggactcacagcagtgaacgcccacaggcttggctgcgagttggggccggcagggcgaccccttctctgaagcgccagccgcagagagagccccctgaaccccacacctcccaggaggcagccggtacccggcgtggagtgacggggaggcggcggctggcggcacaccagcggcccagatgacaccggaaggaggcgcagccccgcggagccggctccccgggcttggagcttccgcgggggcggaggatgtcgtccaaggggaggaagaatggcggtggcccgagggagcccaagtggagtccgagggccgtgggtggtggagccgggcctccggggctccagggctctcaggccgtccttcccagccaggtggcctcgtcaggcggagacagaagcagaggcctgggggccgccctccgctcttcccaaaggcccgaccctctcctgcgcgggcgctgcccccggccctcctgccgagccccatcagctcgccaactccgcaggccagcccggcggcgccatctggcggtccccgggcgtcgcgcctccagctgggtctgtgcgcgcggcagagatgctgggcgtgggaaccggcaagtcctggaaacggcttagggcccgtcagggagggcagttccacgcctgctggagggcaggccgcctgctgcgcgcttctaatccggcccagcttgtctttcccaatgcatacattcatctgctgctcttacatcctgccacgtggagagtgggaagggaattgaggccaaagcccttgttttcacctgttttgggatcctgttgagtaggagtttgctgggggcgcccgtgcaggacccccttgagggcagttggggaggcacgtgaggagcaggacagcgcataaggagggctcacacagcccagagcctggcgggaggccccgctgtgggctgaggcgtcaccaaggccgccaagagccccgccgcgctcccagggctgcacagctgccagcctgcttggcgagctccgggagctcagtacagccctcacctcccactgtctcctgtctgcgcaccagcaggcggccggccaggccctgagtgctgtttcagtgtccaggcctttgccatgtcagagtcggtgatgtccactgaagcagctcagcggaagtagaaagaagtgacgtgcttcatggggcctgtgtggagtcccaggtctcatgtcttgcaggcctggcctggcacagccacacatccctagaagagcagccaggcacaccctctgcctccagtgggcactgggttctgttgctaccgataaatacatgcggggtagacaactagcagcacgatgctcccggaaaacacactgaaagtccattttcggcatcagatgagtggaaaggaaatacagatggggtcaggtgcagtggctcacacctgcaatgccaacagtttgggaggccaaggcaggaggatcacttatgtccaggagtttgagaccagcctgggcaatatggcaagacccctatctctacaagaaaactttttttaattagctggatgtggttgtgctcacctacattcccactccagtctgggcaacagagccagacctcatctcgaaagaaaaaaaaagcaacaaaaatatgacatgtagtaaataattcattgttgtcccagactttctttgaaacagctttgacctggagcatctgggccgtgccacagcttaggcagggacagtcaggagtagaccctttggggttcagggcaacactggggttcgctcacggtggagtgctggtgggagacagccttcatcagatgagggagggcccccagtttctttcttgttcttctaagcccgagcaagggctcccttgaaggcttatgggtgcatcctgcacccagccctgccgcagccccctgctgaggaggctgcggggagcctgtgccacgtgcctgtctccagctggcctgccctctgcacaggcccagctcatcgcccagtctatcggccaggccttcagcgtggcctaccaggagttcctgcgagccaatggcatcaaccccgaagacttgagccagaaggaatacagcgacatcatcaacacccaggagatgtacaacgacgacctcatccacttctcaaactcggagaactgcaaggaggtaagccacacccaccagcctcagggaggccacatttgccagcttctgctccctgagctcctgcagagcgagccttcccggggtcctcacgcacacccttgccttcctatcagactccagtggggcccggaatgtgcacctcgctcctgccttccagctgagcacttgggtgtgaaatgaggtgtttgtaacaaagaagctgattacagtcagctttaatgacctcgaaaatgcgccttttaatgctgctattatcatcaaccagcactcagcacccaggagatatttctgaaaagcatgtggcatctctaaagggagcctgggggctctggcagaggaggctggaagccaccagtagcagaggccttagctggtcccagtggcttcccccaggggactttggaaagttcttatgggcagaggagcaaattccctggggatggcccatacctggactgtttgttaaatggctgaatgattgtgtctgctgtggatgagtggatggtctctgctgcttgttgaatgggtgaatgcatgatcctggtttcttgctgaagacattccaggcagtttctgagacagtgacctttgagaggaaataaaagtagaaggacttttccaacaagagtgaaggccgggggcaggatatgggtatgggagcctgagaacattcctctggcctctgtgggtgtggaaggagcaggaaccaggacactggagccctgcttggggtgggaaggtcagtgttgggcacgggtggggttggggtcaatgccaggcacgggtggggatagggggtctgtgcttccaggttcccaggattgctgggtggaccccaggaaggtgtgggagccagactggggtgaggctgggggtgggtgggcagggctcccagcccaagacctctcctggctgagatgagccagccttggatcccagggcagggcgggatgtgccaggacagggtcagcctcatcctcctgtgggtccttggcagaggcctcggtccttgccgccagcccctctcacactgctgatccctttgcagctgcagctggagaagcacaagggcgagatcctgggcgtggtggtggtggagtcgggctggggctccatcctgcccacggtgatcctggccaacatgatgaatggcggcccggctgcccgctcggggaagctgagcatcggggaccagatcatgtccatcaatggcaccagcctggtggggctgcccctcgccacctgccaaggcatcatcaaggtaggcaccctgggatcctccgcccaggggtcacctcaaccctgcctcacttcatccccactttgctgcaatccccacttcactgcaatccccacttcacccatggggaaactgaggcccagggagacccacccggtgactggtcgatgatggtatcagaatttgaactcaagaccattccccatgtctgaatcagaggtggacccgggctggcctggggtgggaagggaggggttgtctgagccctgtaccgagccatgtggccctgggcaagggcccaagaaccagtgagtatagggtgaccagcttatcctgctttgcctgggactttgccaggttagcactgaaagtccggcttctgggaaaccccctcagtgctggtgggctggggaggtggggcaccctgcatgggttgggttctgggacgcaggttcccttaagtaaggaggccaccctgaccgtcagactcgtgagcttgcagctttgggaggtgctgcctgtcgctgtgaggggtcaggcagaagggtcaccggcagctagggtgggggccttcacactggccgcctgcgaaggaatgggttctgcctgctgctggcggctcttgtgacccagctgtggcctggcccccagccctctgtggcatgttcctccccaccctgctgtggtcttggtgctggaggaagcgccttcctcctctttgttcggcatgagagatgaagggcattccccaggccagagcatcccatagactggctctcggagctggcccggcagagcgtctgcccgatgggcagccacacagagagacatgggagaggcctccaccagtggcaccagagggctcagcagttgaggccccccctcccagggctgcagctcccaggtggaggcttgggttcctccctgtgcctcctcacccccaccggaccccggcggcctggcgcacccgctgacaattgcgtcctcactcacagagatttgctgtgtggtcactccctgccctgcaggaggtccgtccttggagggcattgggttttgaggaaggtgtctccacatccttccgtaggaagctgtcccgaattcggcatgatgatggccccctcgacaccctgagggtgacctggtgccaggtgcgttggttctgcccagtggcactcagaacctgggctcgctcctgcagtggctaatcttccccagggcagaggcaccctgcgcatggtgggacagagggcgcagtgctgccctggaaacctggtagctctggtaagggccagggcgaggcttgtccccgctgcacagaggggctaccgaggctgagaggggactgcctgcctctcccattgtgtgttctcactgcccccggcctccaccaccctgccagcctcgctcatcctgggtcaggcttgatgtctaaggcccagcctgtgactcctgtccccgtgctctgcagggcctgaagaaccagacacaggtgaagctcaacattgtcagctgtcccccggtcaccacggtccttatcaagcggccagacctcaagtaccagctgggcttcagcgtgcagaatggaattgtgagttccccctcctgctctgggccaccaccaccactgcagggcccagggagggggagcagctcccgtccaatggggcaggctatgtctggcagcctggtaggacctggcctgtggttgcagctgcccacagccaggccacctggggcaggaactttccatggctctctgggaggtcctggctagaaggggagggccagggcatggccgtggattgggcccctccagcctttcccaggctcccttgtccccatggtggttgtcccctgctttggagggagggcagcagacttcaccagccactgtagcttggacacaaccaattgtggcatcacttactgtgctcaacaaacagacgttcactcattcattcattcatgtactcatcattcgcttgttcactcagccattcagcagacatttgtgaagtacctgctctgtgttaggctttgtaccaggcaatgggaaggcaggagtgctgcctggaggaggtgatgctgggcttgagtgagtgtggttctggccaaaaacctgtaccagttccccaggccagagttctttagcccagagtttccaccctctcactgacctgcatttgactggcctgaattcttttttcctttgtttttcctcctgcaaaagacccagagggcagagatgtggccactaagtggagtaaagaagaaaagggctggcaatacccaaattgtttaaaccagccctgagtatgaaggagcccaggaggagagacactgcgggctggagtgggagttttgtggaggtgatggggagggtgtgtgcccacccacagtcaggaaagacagtgggagaacattctagaaggactaccaaatcttctccattgttttctggtgaagcagcatggagggttacacccaccgtcagggtggagtcccagggcttgggtttagggtccatctctgaccctgctgtgtcagagcaaatttgctgctataaaaaagagtctgcaaatctccatatactgagagcttattgcttattcatgctgcagtttaatttgcagtgggggcggtgggggtgagcttcactccacaaagccactcaggggcccaggctctgccctcagctgggctttggcagcccccactgggtgctctgtgtctcgctggcactgcaggaagagaggcagctcagaagaccttgtgaaggttttcagggccagggcagaagtggcccttgtcatttctgcccacagcccactggccagatagctcagccacggacccatggggaggctgggaagtgggggccagctggtgcccagaacgaagagggacaggggcatcgccagcgtcagccataccttccctgctgtgtgaccctcaacaagtcactgaacgctcactggattcccctcaaaaggtgcttgtgaagatcagctgagaaaatccataaagtaccccaagctatccaaggtgggcccgctggtcctcgtctctgccaaggaggaggccccgtggcccctggacctggcacaggtgccaggacgagttgtctgcaccccacttgggacttcaggacagtgcgcctgccgcaggagctcgccagctggtggtctggcctggtccggctctgcctgactgctctgcacacatgtgacctgggcacaagcagttgccccagctaatttgggggctctgcagaaaatcagctggagccctgtctgcagctgctgtgcgcactttgtggatgggcatggctgggccccagggaggagggctgggacatccttctgggctactgcacccccgaccatcaccaggccctgcctgtgtgcctcccaccccagcactggggacagtggaggaagctggggactgacagccctgcagccctcatgaggagccgtgctgtgcagagcctggggtgctgtatggtgtcccctgggctgcccctgcctggctaaacctggtgaccacactgcctttgcctcctgagtggcactggggagctgcttgtcctgttcctgcacccccttgcccagcctaggaggcaggtgggcctgggttggtggccagtgctgctcactgacagccctgtcgctgtgagccctgcaggagaggctggctttccccaccatggggtggcctgggggctacctactcgtagggcctgtgaatatagccctgcccgggatgagtttgatgccccctcagtctgctggtcttccccaaactataaccccatgaggagcacaggaactggagaagctggggcacacagaggtttagtgacttgccccaggtcacacagccatgtggagcactggtggggagagggggagaagagatgaggaagggaaggactccggtttgtgttttgtgggggctaacatgaatgggaaaggaggggacagcctggagcagcccagccaagcccaggtgcagggttctgtgcctttcttcccagagagctggagagtgcaatgggcaggtgtgaagtcaaggcggagggcagcagacggggaccagggctcgctccagctgccttctggggcaggtgcagaggggtctggagtagctcccaaagatggggcaaggtgggtccgagtggccaggaagctgagggtggtggtgcggaagggggtttctcagaagatcagggggtgcagggttgagggcagcagcagacttgcggggcctgcagtgaggaaggagtcatgtgcaattctgaagacaacatctccggggtggcaatacgaaagagagggtgccacccacggctcggtgtctctgccctgggtctagggtctgagttccggagtgatggagggggccaagcgtctgtgaaacttggggggtggtctgggtcacgactggggacgaggagggtctggaggtcccagccctgcttgtggatgcgctgttgttccaccctctggctctgcctccctgtctgtgaaatggggtcccacttccttgaggcctcagtgctcaggatgcaggggagatgctggcagccgaggagaggggcaaatgctggctgtcaggggctttctccaggatacaggacagctcaccctgagagtgccagggagggttagatgaagcaaatgaataggcatggttatgatccatctccccagtgatccagaaaatggcatgcaggcggccatatggatcagtcaccatctctgagtggctcggctgcctggcggtaaacaccgggcccttcaggcccccaggtgcggaccacaccctctgcacctgctccatgagtgcccgtggtcatggtgggggttgagggtaggggtctggctgtccccatttggccctctgtgcacctagacacagaggctgtcacagtggctgccacttgtgcccctgcaggccagggctcatccaccccagggccatgtccaggcatctgcctggctgaggtgcactggggctccactgcccagccgggacctccagggagcaatgagcctgggataacattcaggagacccgagggtgctggctactctggtccaagcccctcgtccctcacagcgtgctcaggataggacccgcagtcccaagggccctggcctctactttcaggagcctggaaccccgggctcctgctgtccccggccctgcagcagtggggcgcttcccttggtgtcacctctctgggcacccccatccccaccatgcccagtgaagctctcacctgtgtcctcccgtccttgccaggcccttcgcctgaagtcctagctccagctggcctggggcagccactcggcaccttgtatcccgggagctggtgggcagggactggggttcccctcagcctccatgtgcctggccacctggggagcatatgcaggcgctggaggatgcctggctaggagtctatcagctcctgtcccgacctgcagcggttctccctgatgaccacagaaacattccctgtggcaggtggcaatgcttagcacccagagcgagcagtcagatgagatatgggccagctgcagaaatctgggtgctggtgtgtaggagacggggaggccccctcacagttgtctgtgtctgcatgtgtgtgtacacgcatgtgtgtttgggacaggtgagtctgtgcttctcccatcccaggccactcgcctcctcccagggctcagcacagtctcctttctccaggataagagggccctggggtggcgaaggagctgccttgcggtatggaatctgcctctctccacccccttctcttctagtcctaattctccttggacatccatttttccggtttttgttttcatttaaaaaataactgtggtaaaatatatctgtaacttaaaatcgagcatcatagccattttgaagtgcagagttctgtggcagtcagtccatctgcatgtcaggcagccatggccactgcgctctcctgcacgtcttcctcctccccaacaggaactttgtccccactaagcaccaccgcccatttctccttcccagcccctggcggccccccacttctactttgtctctgtgattctgactaccccaggtacctcatatcagtggcatcacacagtgtttgttcgtgtgcctggcctgtttcatgcagcatagtgtccccgaggtctgtccgtgttgtagcacacttcagactctccctcctctccagggctgagtactgtttccctgcaggcctagagcacattctgtttctccgctagtccgtgctgtcaccctcggctgttgtgaacactgctgctgtgaacacgggtgtgcacggcgcctgttttccattctgtccagtctcgtggtcacaggcgctcccaggccctcctgtccatctgtttggcgtcacttttaggctggaatggaagcccccaccgctgcactccagcctgggtgacagaatgagaccctgtctccaacaaaaccagaaccagtatatttggcacaaaatgcccttacgtcacttggcgggggggggatgtaggaataaagtgactcttccctgtcgatgtagaccatttgggcatccggcaaacagagccttcccttgacagaacagatgccccacctttctggtggccaggggacaggctgcctctcctttcccgcccgcccatcagctaagtgcctgtcttccaggatggtaaccaggctgtgccgtaggaggccaggtggcagtggccttgggctgtgtcaccagtctctagcctgaccacaaagggagcggccctgggggaggtgcagctgggggacaggttccaccgtgggagtcagaaaacttggtggttccccacacaccatggcattaactctcttgttttaaagaaacatactgcatatcataaggatctctgtctgtgagtcagcgaattgcacgtgcacgtattcatcatgtggcgcttttccctctgcatgtcccatctttggggacgtggtggagcgcctgtcgggtgtggcgggaacacgtgtgctgacctggccatgtctgcttagatctgcagcctcatgagagggggcattgctgagcgagggggcgtccgtgtgggccaccgcatcatcgagatcaacgggcagagcgtggtggccacagcccacgagaagatagtccaagctctgtccaactcggtcggagaggtaaggagggactttgagtgtgcctctgcatgccggttcccacgtgctcccgcctgccctccatgagcctcccccgctccagaggacacagggcatctgaaggtcagccaggctgtgtctcccatcggggctgctgtgacaagggtgaatggagcggcaggtgatgcggagccatcccggtctggctctaactgagcaaccgggagggcacaggctgctgggggtgctccctggacactacttttgggactggacctgtatgtccagttcagaagctctgcagggcacacagctctggccaccctggcaggcttgcctctctgcccttgctggccatcccctcccacagccaggctgcttgccctgtcccacttcactggctgaaccccccacagtccagttctttctggcatcgcttccacggcagtgtgaggatggtgtgggggaggtgcaggttttcctccagagctcacaaggaggcaggatcattgggaggggggatggtgctggggaggtggcacatacaccgggggaggcctggccagtgcgcagcgggtgtgcgtgtgtgtgtgtgtgtagtgtgagcgagtgtgggtgtgtgcatgtggatgtgtgagagcatgggtgtgtgtgggatgtgatgtatgagtgtgggtaagtgtgggtaggtgtgggaaatgagtgtgtgcgtgcacgtgggtgtataggggtgcatgagtggatgggtgtgggtgtgtggctgtgtgaatgtacctgagtgtgcgtgtggaggagtgtgtgtgtgtgggtgagtgtatgcggatgtacgtgtgtgtgtgagagcatggggtgtgtaggagtgcgagtgtgggtgtgtgcaggggtgtgtggctgtgggtgtgtgtgagcatggggtgtcaagcatgagtgtgtatgtgtgcacggctgtggctgtgggtctgtgagtgggtgtgaggcatggggtgtgaggagagtgtgagtgggtgtgtctgtgtgtgtgtaggggtgtgtgaaggggtgttcagcacaaaggggctgcaggctctctgggaagcgtggtggccgcacgaggcgggaggctgagagctgaggagcccggcctacagaggggcccgctggggaccgggcagggaatttgggtctggggacagcagcagcaggccgggccgtctgtggtgctccccctggtggctctgtgaggctgagtgcgtggcgaccatccttgcagcctgtgggtgggcgggtgggtggaggggtctctagttcctgttcttcggatgaggtctccaggagccacatcgggacactggtattttgtgcactgcagggtcggctgggagctgggaggcctgttttccctggactggtgggggcaggggtctggctcaggaggaggaggggccaggcggacaccagcctccctttgatggcttcaaagaaaggaaaagccagtgttcccaagtagatgctttgaagcggccgcccccacggccagcagccccacacctgtgaggaaatccacccgtggaggagcgggcgggagaacggggaagaggcaggaggcggccggggcgttggaatcctttcagccctgccgaggttatggtgcctgtttccagcagctctgagcccacgcggaacatgagtcgctgataaacaaggcttgcagttgcgaggggcctcggggtgggtttctggttgaggaacgccggggaatggctgatggaggaagcccctgccgggagcaggagcagcggaaacctacatcggccacacagatcccggcgggggagggagggcaacgctcagaagcagagctgcgcgatgtgcctttctgggctgctcagcccagggcccgagacctgcttgcctgaggaggggcagatgcacggcggctgcaccccgtggggaggccagcatgcctgcggcagctgaccctggcagtgcgagggccccccatccggaggccgcagcctagcacagtcccgggcaggacaggggagagcgtcgtgctcaggagaggagaagtgggcagtagagctccctttccgttcttgaagcagacgtttagagtctgctccttcccagtgtccgcaaagaaggattacaaggcgcgccacccacacggttggtctccctggggcggtctgaggccttgcttgtatacccagctcctttggagtcagggctcgaggccaggccccaaagggtcatttgctcaccgatccccaaaggctaagaacttgaggtgccctgggccccagcgagcctgttcccagcccccagcacactttcctggcccgtgtgtgttttgtaagaaggggtgtaggccgggcgcggtggctcaggcctgtaatcccagcactttgggaggccgaggcgggcgtatcacgaggtcgggagattgagaccatcctggctaacacggtgaaaccccgtctctgctaaaaaatacaaaaaaattcgctgggtgtggtggcgggcacctgtaatcccagctactgaggaggctgaggcaggagaatgacatgaacccggggggcagagcttgcagtgagccgagattgcaccactgcactccagcctgggcgacagagcaagactccgtctcaaaaaaaaaaaaaaaagaaggggtgcgtgtgtcttcccccattgagctcctcctcagtgaagcagagtgcatccctcgcagtttctgccgaggcctggccacccccagccagccccagtggatgggcaaactgttgtcaccactagaagtccaatttctcacccctcgggtgtcagctggactggaagcaaaactagcactcaactgtattgactcctctggagccaggggtggggacctggagtctcagtctgctgcatctggaaggcatcataagtgtccccaggcctgggcaggctggccttcctccttcactctaggagatgggcatttgaagcagaactctggggggtttgcctctgtcctttgctttcacctgattgtgggaggggaggtgggagggcagcggctcagcctcctgtttctgtccgcagatccacatgaagaccatgcccgccgccatgttcaggctcctcacgggtcaggagaccccgctgtacatctaggccaccccagcctggccacgcagccaggacaccgggcagggccgcccgggcccagaggagctgggagccgggccgcagacttgaccccgacgccacagcccagccacggacgctggctccccaaagggtgtgccctcaccacccacttgatttttttcattttgccaaaaaggggtatgtctttatcaaaggagagtcacagaacaaatgtttgtttgtaaagcgttccaagtattttgccacgttctggactgtcttctccctgcacaagccagggtgtgtctcggtagctgtgcgtggtgtggagtgtgtgtctttcctccctgaagctgtgcggagcgaactggcgcctccgagggacgcggctcccggggcagggcagccgtcacccctgcctcccgcccccttggctgggacgtctggggtcctgtggggcccccacaatggtcccaaacagctgcctctgccactgactgcagggacacgggcagcctggctcccaggacacgacttgtaatgaaagtttggggacatgtgattgattgattgattgtaaataaaggatgatggccacaacatgaaaactccatatttatttagatgctattattactgtttggacttttattttggcaggcttttttccagactctagggttttccaatgtgactaatgaccacacctgcctctcccgtcgtctcttctgggcaccctcccacccggctgcatacccgggcagggctcccacagagacaaggagggcacaggtgtctgccccctctttaaaatcgatctacacacatccacgcacatgcgaccccgaggaaacgaaacccactctagaaaacgcgaccttggccgcacctaaagcagccagccgtgagtgcagaccccttggccagcgtggcgcagtggccctgagcagtagtggcatgtgtgtagatcaagtcggatctagtccagctcggttcattagcgatccatgtaatctgacgtcatcttgtctcgaagtctctttttttggcccaggccttgaagaatacactgtgacttaagaagccttaccacgcagtaactaaagctttaggatgactgtattcgaggagtgccgtgtgttgcatgcagctacccgtaggaagacttcgcgcatatcactaataaacctgaagtcgtgatgaaaagccgtgtgtgtgactggtctgttacctcagcggcgggtgcccgcctgtcctttcattcacagcttggatgcggctctgcaaattcactatgcggtggcagccacagctgctctgtgctcctcctggatcctgaaccttggaagctgtcactaatgagttcggtgggtgggtgctctgggcaccaggtgtcagctgggcaacgccccgctgcaactggaggtgccagcaatgctaccaggtcacggggtcagcgccaggttcttgacccacttgccccagcagggagacacgtccgcagagcactcactaatggaatgagggagccagggagccttgggcttcttcagatttcaacgtaaatggcccctgggaaaggtgtgcatgcgtgtgcgtgtgtaaaagccggaccgcccatcccagcaccctgtctgcacctgtgggtcctttgcagcctgtctagagtgacaattctggcagctctgccagcacttacctttcttcatggccaccgttctggtgtcacctggtgtgggaaagccaggtagcaagcacgggctttgttcagaggcggtggcctggggtccagctgggttaggctgtgggtcttggatgggcaggagccctcctctctggcctgcccacagcagcgtgagctccttgctgtgggcactgaccaccttcacggcccaggattcttggggaactgcagagtaaggagaagacttactctcacctagccgcccagagggtgtgggccaagggcttgctccagcatgaccttggccatcaggggcatataaaagagacggcctttcaaggcgcacaccagctttgtgcctccctcttcccagaaagtatacatggtagaggcaaagaaagctgttccataggagactgtcacagagagctgcgtatatgccgaaatgtatatgcactcgctctgaatgaatatgcttaagaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttagagtataataaaaaaaaaattaaaaataaataaataaataaataaaataaaataaaataataaaataattcacaattctagcaaaaaaaaaaaaaaaaaaaaaaagaatgaaaagcaaatacaattctcgacgtggccaacaaacaagaatgccagggatggccacatccttggggaatgaagagaaatgtcgcctgagtcaaagctggagggaacgggattccactcaggaggccaagggggacattcctgccgtgcccaggacaaggcggggaagcaggtcccggggagagagccctggctagctgaggacatgcaggcaggactcccaccaaatcatacacatctttaaaaaacctgtatttaaggaaacatctgagccatggcctgcattcctcccagcagcccttggaggccatgtccatggaggggctgccatggccagcgtggacgggcgtgggtgtgtccaggccctggccctccccactctgccccggagttgaccctctccggaaggcttctggaagcacagctgagtggcatgggtatcccaggctccccggctggctactgcaaggtcctctcaggaccctgcccctggccactggggtacacagcctctcagcctgcctctgtcccagttagacctcagagacacagaggccagaaatacttctttttattaaaacacggatcattattaaaacaccttgaggtacattaaataaatacagcctttccagttgtacagacaggtctctggtggcttgaaaacaatttcctataaattctgccttagcagcctctgagagtcagcatgggtggggagaagcatgtgtgtgtagcgagctttctgtggcctggtgtgttacaagcatttaatgtggatcctcatctccagccaagggagacctgaagtccttgcggatgatgctcccccttctgcgatcttgcttgccatagagttggggtccatgttctccccactcagcaaccttgtggcccccaggctggggtcaacggtggtgtcacagcaggtgccaaccccctttgggtctcaggggagggcaggggatgcccggggcccagctgagttggagaaggagcgtgtcacccccaaagcagccacagttggcccatttcagatcccagatggaacatgattggagcgggggaaagacgcatagggaggggaagcagccagctttctcctgggctgtgagctgacgtgcagcccggggcctgggctcttgctgctggtacccggatgccgtggagccggggccaaggggaccacagcttctgggtcaagttgccagcacattccctagtctaccagcacctctctcttctggggaccttcccaggaagcccagaacctggaccctcctagagtccatgagtggccctgagcagcggggctgatgggggcaccccaccccgtccctgactgcctcatttcgaaggggcagaaggttccagcccagcggcatcaagttgggtacagtttccgtatccacaaaacagagctgccaccagcgcaaacccagagctgggtgaaggtggggtgcaggtgaggggcctacagggaggcactgctggggcagcagccccattggccattgggaccgggccctgctgcagagaagggaaggatgctgagcagcaggctgagggggtccagtaggcctctgccccggctgcatgaggagaacaccccagagaccgagtccactgggtggctggtggtcttggcctcgctggaattgcagccatgtctgaggactgcagctctagcccacccaagggctcagcccagggacaatgctgtgtgaacccccaagccctagtgtggacccccccaagcaggtgaaacccctgcggcgtggccccagcgcacctcagagacagtggagattcagaggccagggcgtcaggcgtggctgaagctcggctccagggcggccattctgaaaatccaccaattaatttcacctgcaaagggacttgccttgagggaattcaaaagcccccacttgaggaaaattagagatttcctgttttatagtctgaataaagtgctcaaaaattcatctctagtacgtctctcctgcaaaagtgcaggttgtcatcaaaaggcctggcttatgtgttttcagctctctaaagcaatcgaagccttttcagccgaccacagctgaaggagtcccacaccgcagcccccagggcagggataaaggactggaggaaggctctgggcacctggattggaacctcacccccttcccagcttccagccacacagaagctccccagcacactggccacagtggcattagggaattgggggagctcaaggacaagccccacaaagccgagggaacagcagcgtgagccccctgccctggcacccaggagtggaagacaccctctggtccccctgcgcccccatgccaggctcatgggctctctggggagaccttggcctctaggctgttttgttcaccgcagggcccacccaacgcagctcaggggctgtggctgctagtggccctgaacaggcatttccatcactgcacaaagttctcgtggatggcgctgttccacggccattgttgggagcagctgccactgatgccaccagaaaacaaggggatgggggctaagaaagtccaaggtccccaggctgtccccaagctgggcgtgtctgcttctccataagcagcacgttgggtgtctgcttcccttctcgtgtgggtttgtaagtggtttatgatcctcctgcgcaggtgtgtctgctgccgcatgcccggggaaaggtcagctctgggtcaaagggacctgctttatcaggaggggctacttctcagagaaaccggcctctctcctgcagaactgtgacccgctgagctcaatcaagtgagctcagacacaaaggagctgggaatcggcacttgttgttacggatcacacaactgctccagggacaggatgggagcctggagaaagggggcccaagaggagggggggaaggcaccccacggagggaggccgagctcaaggcccaggagatggtgggttcctccaacccccgcaacaccggcctgttccctggggggggccgggctatggcagaggcccgcactgcacatttgtttgcacaatagccctgtggacagaaagttgggcccaggctgccatctgtgctaacactacctatttcctttcacaggaaataggccagagcgtgatgaacgcctaatgatagagccatcgagccacatgagaaaatgtttcatgactcgatgtcaccctctgtccactgaacactaagttaaatgggggatgggagactcctgctttggaaggccctgattttggagatactttgagtctttaggtgacgtaagtgtcgcctgttgctgtattcacatttgtgcaacactgctcagttcaaggtgctgcacgccagataaaaccagagagttcactgtggacgtgaaagtcatctttccgaattactgggctaggcaggaaatgcaatccccaaagagacactgctcggctcccctcgagagagggggtaacagttccctgcccacaccgcccccagatcatcctgggtgtcccccccacatttatcctccgccaagctgggcctgaaggcctctttgtcaggcatgatggcttctgccaagaacatctgtggcgccaggcgttggtgtccacggtcagaaatgtggctccttcatacctggtccagaacgtcagcgccgaagacggcctcctcctcgaggcgctcctcgttggtgacagccaagcgcatggcacccaccatgtgctgtgcctcggtggggagggcacagtgtgagtgttccaaaaacttggccaccaaaaccctggcatccgcataggccttgctgtccactaaagagcgtggccgctctttggaggtcgctgggaagggctctggtgttggccgttggtcagttttccaggtatctgggtcccccgctggtgaaagctgggcccgacaggcagccgtggcagagcgagacatggaagctaaaaatcaagggcaaaagtgcagttcaaaactcactgaaataagaagttaactcaaaagcaaagaaaagcctgctcgggaggagcctcctgctggggtttctgtgttcctggggctggcgctctgggcatgccctgctgtccccatccctcctccccttctcaaccccaaactgaactagtgtcaacctccaggggctgcagcctccaggagcgaaggcctggggggaagggccaccacagcaggcagcgacccacttctgccctctgctagaatcccaagggcacaggggctggtccttcccagtcttctcgcctccacgacctttgcccctttgggtctgatctcttgctggggcagaatcatggcatctagagacagggtctgccttaagaccagaactgggggtggcagagggaacatgagaccgccccccccatcatgccaggtgcaggcagccaccactcagtgccctgctccactgcctgccaggccagaggctggggacctggctccagctccccacagagctgacagcctctctgcatgacccacaggctggacactgggctgagggtccctgtaagacggccagctccgggctgtcagtggcgagggacgccaacaaggaccagcgaaggcccggcttgcccagcctgagcttcacgccacacaaagttggaacattctgggtcgtctgttctggtgtcttgtttggtggcaactggaaagcctagcaattaaacatgagaaattaagaaactcccaggtggggcccatctaccccagatgaaatctcataaagtgggctgagcagtcacaggtgtgttaaattagtgctagccctggatataagtgcaccgagagacaaaggaagagaaaggccctcaaagccagacagtgggcagcccccattcccgggggtggggtgaggagctgcatttggaaacaatgtagccaaggacccaccaacacccgccccacctcccagcaggcgcagtcaaagcgctttagaaaagaagcgtctcaccgctcccaggcacagcctcagacagtcccgcttccaggtcctggctacacgacggcctgtgtgaagaggcatcgccttaaccagaaggagaattcagtgaacacatgaaaggaaaaaggaattcctgagaaagctatcataacccgcctgtgactaagacattttagatggcgagcaagcaggagaagcctgctgagctgacacccaccgagcggcagatcagacaggaaccgccctgcagctggccaggcctgccgtgggtcaagtggtgtcccaggtcccaccctgacacagtgcaatgggccagtggctcaaagaaagcccagcacccttcatgggaattcccaccctcacctgaagggctccaggcaccctggaaggcatgtgcctgcggcgtgcacatcagcctagccaagaggggacagaggcgtcaggcgggtgtgtgggtgccgaggtgtgaatttcactgagagggacaggcccaacaaagccatcagggggccacagagtggacccatgagcccctccaagtacagggcatcctcctccaaacctcagtgagtgaatgtgagcatggtggagagaggttccggagctcaagaaaccagcagaggggggtgtttcagaaggtttgacgggactctctccctgtgagctggcaatgggatgcaggaaggaggaatacagagatgaccgcagccagggagtccacatgtgccaaacctggtatttccaccaggagggtacctccaggcaactggccactgcgggctctggttcctttcagggactcggttccgggctccagtagagatcagctgggcaagaccatcgaggggagactgagccaggacccactgcgccctcttcagggttcctgcacttccacttcatgaaaagtccccacagcaatggcatggaggtcaaaggcccaccaatctttattggcagaaactgtgcctcctctcaaaagacagtgatgaggactgggtgtgagttctccagcgccgggggtgcccaagactcccggggagctactgtgaaatgcaaattcctgcgctgctggccacagggacctggtgccaggtcctaggctccagggcactgcccgcagacacagtcgcatggggcgatttttgaaagctctgggctgtgtggagagccaagctgcctgggaaatgctgctgaaaacgcacctgtgtctgcgtggggcggctccagctgatgacacccccatgcccagagctatcgttgggggtcatctgtcctgtgccagactctaggccttttctgggccctggagcacgtgtgcagcacttatagctaatgtcctggactgggccccgggccccttgaatccttcctcccctgccagagtgacaagcctggtggggtgcagaggggcccacaggctgctccccacccacccctggctcaggggccatcaagaccacattcccagtgtggccccagacaggatctgcagggccgggcctccactctcaggggtcactgagacctgcagcatccaaggaaagctggccacactctggggacatgggtgagcctggccaacctacctgccatgctagatgtgcacaaggtggggtcgctggtggagcgggacacacgcccgggacctggctgcacctgtgagcccatgccaggatcctctggagacacatggccagggggaagggcaggttcggagggtgctggggcgcccacagggccatcgggggatgggctggaacctggcgtagcagtgccctcggacaccaggaggcttgtgctgtcagctggtactgcaagagaagggacatggcattagagtgggcggccgcaggggacgctggcgtgggacaggcctgcccctcaaactccagacctagatgaactctgaaaccctgggggtgcggaaacactggataagattgacaaatgctgctttatgctgttgaaagttgggggcaccagatgagctcccagaaatcattccaggaatggcatggttcgggggcttagacccttcacactacacaagagactaaaagtcagaaatcagacactttggtcacaagacgctttggtctgggtgaacagggccagtgcaggggtacacagcagccccaagggacatcaaggcatccccaccaggtcgcggcaggccagatctcaggcccgcccttgcaggggtgcagccccgggcctggagtgcagccagacagggtggtgcaggcaggtgggataaactccgcccaccagacactggccttggctctcagggtgtggacgccacgccagcagcagcagcagccttgccctgggaacaagcggggaatgcagactctcagctggaccccagacccatggaagcagagactctggcgctgggcccagccaccggggttgaagcgagccctccagggaattctgatgccctccaaactgtaagaactgctggtctggaccgggatgctggtcagggctgggctcttgccgggaaccactctacgggggctggatcggagtctgttttaataccatctccacggggtgtgcatgcatgtgacagtgtgataagctgctcctgcactctcccctcccatcaccaggtgccctcagagccccctcctggcgccacagtggagttgcctgcatgggggacacttcatagatcacagaagcctggactcctccaggcgtgggggctttgggtctgttcctgccatccctttctgtttttccctgcgtctgtgagcctgcccatgggcaacaggcttttcaggccacctcccacttcatccttcctgtccgtctgtgaggcagccccaggttacccccaccctacagctgcagaaatgggcttagacagggaagggttgagggtcacacagccaccaaggtggtcctctactcaggagagtcctgacccctgtaccccagcagaagcctcggtgctggaagctctgctggtccctgggtcagctgtagagttcaccgcccaggtcccaggagggaggaagatccagccctgctgaattctgggtgaggagcacccctgtctatttccacctgccctgagatgggaaacaggaaggggctcaggtagcaccagcccccttcagcccaaaccctggaatgctgcaggtgtggccgccctgtgacagtgactgagatacactgtaccctgggttggccgtgggaaagtcactgaataccttcttgaacagcctctgatggcttggagtgaccaaaggaaggaaaagattgcttccaaatcccacgactgcaaagatgctgcgctctacaacccccggtggcctcagaaagatggctccttcctgtttctcttagatgctgagtgagtgttcagcaggggacagagcgccctggggcgatcatcctggccctctgtgggatcacatgagttatctaactttgttctccaaataagccagcccatgtgacccctcgcaggggcctcaagacggtggctctctggctcacttggcctccgtgccctttctccctctgctgctaagggcccttctgctttcctggagccttagaccacctcccccgccccggctctgcacgcgacacccaccctctgtgtctggggatttgacccttgcacacgtgtccttcaatgccctcaaggacatgacttccagcctgcaccctcctgccagccgcccagcccagccaccttcttcagagggaggtgccgtgtggacatttgcccggtaggtacaactttggctctggaaaggggaccctagatggagtcgtgctcttcttcaaatccatatccctcaagtgagaaagtggggcagaggaagacaaggtctccccggagagcgcaggagatctcctgcatatgctgactgtagtggatgcagacacaggaagaaatgtggggatatacagggtatttaatgggaaagactgctgcaaactccaccctcttaaagagtaagaaatggagggaggaggaggaaaaagagaagagaagagaagagaataggacgaggacgaaaaagagacacccttgaaaacaggaacaccccacttcaggagctgaaagaggtaagcttacctggagtgctgaagccagcactggtgtttgggtccccggagctggactcggccacctgctgacctatacttgtaacctacagtaagaaacagaaagcgtcaaggcggctggtccgtgggaacgcagcacagcagcctccagtagtgtaggcgcttaaacttgtctcctggtgggaagcgctgagagacgttcatccacacctccactcttctcccctacatttatgaggtggggtgtgagggttcaagttgcccttgccaaggccaaagtctagttttcttttttctttttttgagacggagtcttgctctgtcacccaggctggagtgcaatggcacgatctcagctcactgcaacatccgctgcccggattcaagcgattctcctgcttcagcctcctgagtagctgggattacaggtgtccaccaccgtgcccagctagttttttgtatttttagtagagatggggttttgccatcttggccaggctggtctcaaactcctgacctcaggcgatccgcctgctttggcctcccaaagtgctgggattacaaggtgtgagccaccgcccctggccgaaagcctatttttctgaacttttgcaatcagagagcctggcagggccacagagccacctgagcctacgagttgcacagtcatcgagcttttgtggctttcgatttctttttcttttctttatttatacattttagagacaaggtctcgctccatggcccaggctggagtccagtggtgcaatcatagctcactgcagactcgaactcctggggttaagcgatcctcaggcctcagccttctgagtagctgggattataggcatgagctaccacgccctgcttttttcagctttcttcttggatatactctgattccgcctggagaggcctcagaataaggggaaggctatacctcctctgctctctgccccatcttcattttgcccattctgcgtgggccatggtttccacctcagagggcatcagggcctcccggatgcgatgtttggatgtgatgccagctacacacatgttgcatgagcacccccatgcaccccatgctacctcagaaaacaattttttgaatccctgtgttatttcagaattgctttggggatacacttgcaaataatgagctccagaggagactgggaaggtgaggggggctcctgcgacttgctctgattccagctcaggtaattacatttctgcctcccttatctcccgccacttcaatcagatagctggtctccttcatctctcctcttcaaccaggctgacaccagggcgggggctggggctgcagccttcccacccacacaaagggtgtgagctgcccccacagcgtggggctcgagaggtggttccgagacaaagagaagacggagagctgcccaagtgcgtcctttgatctcactaagatgctttcgcataatacggtccatactatttttcttccttagccctctcattctgctgggagggaatcggtgagggagaattcaccccaccatcagcacccacctgctttttcactgaagtcattatgtgccaataaccagtcctggaaatctctgtccagaaccttccactgaatcacaaagagcgaacaatgtcctaacggtttgtttcatcctgtgtctcccctcccgtatctaaccctctctcggacttgcttttcttttggatcgtagacgggtggttaacttagaactccgctgtctaaaagaaaatcttctggtaataaagaaatataaataaaacaagagaaagaaaatatacagtgggacaaggtcaggaggaaactggattcacttcatgttgtgcagaagcatcattcacttccttctggctcccggtcagatttggtttccagaggaggcagctcctgggagcctatctatcacctctcgcaagcagagtgtcaagagtttaatttaaatgtggcccttccctgatgtcagaagccaccttgccacgctaagccatggggaaaatagcacttcctttcatacagcatttttgatgaactataacagcagtagaaaagggtggggaagaaatatatttgtggcatagaatttaagttgaaatttgagttcagtgaggaagctcataaacacagctccttacagaaggagagcggggagagggctgttgacaggagacgctgtgggaatcacttcacctgggtcttactggtttgcagatgtgctattctgaacagtcatcgtaactggaaaataagttggcttttcaacaaataattcaaattgtatgaagctaagacacttgcatggaaattctgccccattctgtagtttcccactcctgggtgaggccaaccattagaaacagatttatgaagagctcttcgtttggggcaattccagcgattatggaaaatgtgagttaaaattttaggctggtggctcaaggcaaactttgaagacactttgctaacagattttatgtggatcgtaagtgtcaggacctggtgctgctcctggactctgctggtccctctcccttctcacaactccttgtctcgcactcaggttcccttccacctggcatgctgccaccaaattaaactcctaaagcatcactgggtcgcacccaagacgccaaactcctcaagggcacttctacagtttgacatccaaagccataaaatatctgcccaaatgatttcagccctggggtgctgaagctcccacagccaggctccaggctgtcctgccatgcgccttagctggtgctgtgaccttcacctgcaccacctccccctccttcacacaccccagcccgacaagcccccccatatcacctccccctctacacgcaccccagcccacccagatcaccaggcccgattcctctgcagaagcctcaaaggagttcgtgtctgtccggtctccatgtgagagtgcgagagtgccacgacagggggattctgtcctacatcctctggagggccaccgtcgtcagtggcccctgaaccatacgcttgccacccagacaagaagatcaaactggtaatttctcaatcactttcctgctatcaaaagaaactcactccttgaacactggctgaagagtacagcctcaaaccacaggaaagagaatggcatctgacctaagccggaagggaagtgtgcacggcccgtcacccatgcgagtgctcacggagcccaccctcgtggaggccgccccctcttgggttaaacctcttccccagcacaccccctgccccgccccagagtcagctcctccccgacagagcccgccttctgcagcctcctctctttatccaaactgaggccgagggcactttctacgccatttgtcctaacaaggaggagcactactgaccctgcctcgcccgggctgcggggtcgtgctgtgaaggggtgctccttgctgtctagtcagaggggccttgctgcctggggaggggacagctggtggtgcagctggcggcacggccttccctctgtggacggtaatgggtttctttgacttccagactcccagacacggccgtgaattgaaaagtgctcccaggccatggggtcaaagacagtgggcccgagggctctagcggccccttcatcaccagatgctgccctgctgccaggcgggcgcccagggacaggccctgcaggcggtcgtgctgtgcccctgccagcactgggagctgggggtctccgagccaacacatgctaattcgagatcagcctctgacctttcagctgttctcaccgcagttctgagaaagagatctcaactgagagaattccccagagttctggagaagggtgtcgcattggtttcagaaccagccagatcccttccaatatattctattcttcagagaaaacagtaaaactgtgaacacaacaggaacccattccttccgggggccgctgtgaggtcagacattgaatggcacacccaggtccagaagctacttccagcaggcagggccctcgggaagccagggtctgggctccacggacaggggttcctgtcgtcaggaggcagaggggtccaaggggcagggagaaccgggaagcaggctcagagccagtcccagtgcagagccggaattgtgatggcagcaggcagggtcactgagcagaggcggtgaaggggacagagctgcccccgcgccacaaggcagccatggggaaccacacacccctgccgccttcaggggtttccgggtccatctgccgccctgcccggtgcccctgctggctacagcatggagcttcccattgcaccctcggtcagcctcccctctgccttcccaggggcttccctcacggagggccctgtcctgggcctgccatccccagtatctaggtccttccacatctgcctggtaacctcctcaaggtcctagatccacactcccctctacctaccatcccatcttctctcctctttaccaaacatcctgcgagagtgatctactcctgctctcaaagtgggagcagcagcagggctgaggcttttatacccccaacttcaataccccaattactgactcaggagccctgggggtgggcccagtcattaggatttgattatcaagttccccacagggacacccactggtgtctgaaaaccacagccacacctgcgctcccctgcgcacgtgccgtccactcctttacctggtgtggtccagccctgccctccatcgcatcaaagctgctctgccaaggccaccagcagcccctccatggtgcgccacgtggccctggatgttagcttctggacagcacctgacccattgctttcttccagaactgctggttttggcaaatccaggctcctgggagccctgcctagtgccctgtagcctgtcgtgtgtgggggtgcctttctcctgccacctgcaatggtgtcattctgtggggctccctctctcacatttcccaggccccagtgacagcggcagctaactctgatcactatgaactacagctcctgtcatctggtggacactcactcagaattcaacccaccacacccagacaggtcaacacccatgcacactcatccgagactctttacggacgaccttctgtttgggggatacgctgtgcctgtccttcttccctctgagcctttgcacaggctgttccctctctcaggagcccttccagccccactccctgcacctcgcatgcctgatgcccacccagcctgacctcccagaccttccatggacccccaaattgggcctgacatcatgacaggtgccccacagtgtactgggctccccttgcagtgctgatgacaactattatcacagccaactgtctccactgataacattgatttgaattatttttatcataaatggaaaactaaacaacattgggaaggcagaggtcccagctcagctttataaaaacacctaagaacatctccattactgccagttcaggaatgggatttcagggccatgcccacctcctgactaaaggattcctctccacaggcagctcccacacatctgcttctagcacccacagtaaaaagggggtcctggccggggctcagggggccactgtctgcagcctgcctggctgctccaggtgtttcagggtggctgcttggggactgtctgcttgtgtgaggatgtgctgggggctcacgggccagccggaagctgatctggcccaccacaagccaccctgaaggaggtccctgtggtatatatgactccccaggtgcggggcaccttacagcgtctgaatgcgctgtccatatatgactccacagggcacagagaagtcacatctcttcctgtcctaagaccaccctgcctgcaacggtgaccagtccttgtgggtgtgattgtcggaagggcttgtgagcttattcagccaacatggaaactgctcctccacccacagaagctcctcagggtcagcgctgccttggtcactggttgggacagggaccagcattgccacctggcttgcgtgcatgtgggctctcgggatctcaaagtgacagggagagcattgggggtgacatcaaaaggtctgaaccctgtgctagggtgtctttacaggagtcagcagacagcgagcagctggccaggcctgatctgatgcccggtaccagtgcctggccagtgatctgggtagagataaccatccggggctccacggctgctgagaagcccaaagcaggtgcagttctgggtgggcctggatgcttctggtcatgctgtcatctgctctcctctgcttgttgcttgggctcagaattggcttcagcccctacccccgcccctccctggtgaatctgcaagtctcccctgcccacgccctctgctccaactcactgctgtgttccccagccatgccccagtccccgaggcctccaggacctccttggccacctgtcacgggagttctctgcatttcctaaactggactgtcggcctctctagcaggattggggcaatgttcatggatgatatcctaaaatatgttttccagtcgtttgctttctctccctgtatttcagggacaccagtgagctgtcgatttggtctatttacataaccccatgttccttggagggtgggtccttggaagatcccttgcactatgggccacgtgacttttccagatgtccccatctctctgtcctggctagcagcattccacactgagtcatgacaacaacgatgatgaggaggaaacaataccccaaaagggtgactgacttgctgaattcagaacttcccatgttccaagtcctgttggctccattacggacaacatcccatttcgtcccataaccctggtactgttatgatcctcattttacagatgaggaaactgaggctccacgaacatactgcctgtcacgtgtcaggcaccatgaggctgcaggagtgcctggcatgcccagctcagagaaggctgaaaggacctggcaactgaggcacttccctggcctgaagcttcttggcctcagacaggaccagggatccagggctgctttctccccaccccagagggcggtgatggcagtgtgtgatcaagacaggccggggcgccctgggtactcggtccatggacccagctctgctcctgggggctctccccttgggtcaggagctgtcccaggtccttttacctggatcccagaccacctaccagcacaaagctcagacgcacctgggctgtgactcgtggctgcagaaatggaactggggatctaaggggaaaagcaccagcactgggttccccaggcccgggctggcgtctctgcaggtgccgctctctgagcctgtggcctcatctacagcacagggctgataagaccaacatcccacaggtttgctgaaaggcttcaagagagatgaatgcatccgggggcctcggcacagggcgctcatgagtgttcacctcacagccagctcggacctggcgcggtgtgaggtgccttccgagggcaggccgggacggtgtccctagcattcccacgggaactggctttgtctggggccccaggcctcacctggctggcagggggctggcccaccaccgcctcgtacggaggggggagctcagcaggatagagcaggccggggctattgatggccacgtcatacaaagtgccgaatggagacggagcaaagtccaggtggaggcccctgaaaagacagaatcatcacatcgtcattgcccgaaggaggaggcagaagtgctgacagctctcaaagccgccagagcaggggcggccagggcttcccctcttctaatacttcccatcattgtgaaatcaaagcttcagtcactgggcgatttgcacttttgttttttttttttttctggaacgacatcaacattttcaataaactctactgacctgtccattaaaattcaaataatcatacagctgattacatctttcattaaactgtacatgttacacaaatgactgcaacgtgaccgcagctttgcacgtcatgagaacttaaggcagcaacacctgtctgcctccggcttctttcgggttgcgttgcaaaggtgccacggggaacgctgtatgtctaagaccctctccttccactgcccctcctctgttctcaccgccatgcctgcaggaccactgcaactcccaccacccggacactgctgcccatcttagtggtttcgagatgggggcagccgcgggagaccaacctctgggcctcagtggacggtgtgcaggtgtactctggggggtaatagggtggaggcgggagtggggggatgaactcgtcgaaatccagggtctggtggagaacggtgccgtgaggagtcacgcaggtggggttggcaggatgtgacctctgcggaaggaactggaaaacagagacaaccacagagttatctgggacatcttgtgtggcttgtgtctcattaagctaattatacgagagctttaatgatcagtttggaatgcctgtaatttcaactgtcaagccatgactgctaagcacacactttaaaatgaaggcgccaggaggaacgcctcgtctcagaagtctcaaaacgctttgttgcccacgctgttatacagaatgcctctttttaaagaaaacatatggtctgggaagtctttcatgctgtccctaccactccaactggcccctctgatgacagtactcaaagactgcagacggaaggctgcctgacgtgcgtggtttaagacggcacttcggctgggtgtggtggctcatgcctgtaatcccagcactttgtgaggccgaggcgggtggatcacctgtgatcaggatttcgaaaccagcttggtcaacatggcgaaaccccgtctctactaaaaatacaaaaaattagctgggcgtagtggtgcatgcctgtaatcccagctacttgggaggctgaggcaggagaactgcttgaacccgggaggcggaggtggcagtgagccaagattgtgccattgcactccagcctaggcaacagactggagtgtttttgagactctgtctgaaaaaacaaacaaacaaagacggcatttctcaaagtgtgttcatgagaaaacactagaccctcccctcgaaatgtccccaccccaccccagaattcccgtggtcaatctgtgggaaatgccacatgctcccttcttggagtcctgcattgtgcattcgtgtgttaaaggctctgagaagggctgtgctgaagtacttatttagctgtttaacattttaacccagcatttctcaaatatttcataatgggcccctttggacacgtagtatctattaatattttgcagtctcaggatttcacacagtttgtaaaacactgctctgaggaaagagagacaacttcatgagttccagaacattctactggccaaccttgaacaccgagatgctgctttaatagtgaggtgaaatcactttaacaaaaatgaaacctgtttctgcctagttttccgtttctgaaggactaaccaacaaccaactgcttttctttccaccttcacatctctgctgcccagaggtcacctgtggcgtgagatgcctgggacattgctccagctccagtcaatgccgccctatgagtgtctacacggcaagaagatccatgctgcaaaagctctgggccaggggccctcctggcgcagggcaggtgaggtaaggagaggaagggtgagtgcgtgtgtgtctgtatgtgtgtgttgtgtgtgtgtgtgcatgtgcatgtgtatgtgcatgtgcatgtgtctgtgtatatatgtatgtgtgtgtttgtatgtatgtgtatgtgcatgtgtatatgtgtatgtgtatgtgcatgtagatgtgtgtgtctctgtgtgtatgtgtatgtgtgtgtatgcgtgtgtgtgtgtgtgtgtgtgtgttgaggggaagacagggacccagaatcaccctacacaagcaaggacagctccattagaaaacagtgaggtctccaagcactgtgtggggactgcgctccccaaagcattcatgaagaacgcatctgaacgggtcttgaaagattggtgggatttcatctagtgggcgctcagggagacactcaagccccagaacaggtgagccagggaaggatgtgtttaagaaaagcaaatagataaggctctggaagtcaattcttaattctggggcactggggagcctgtaagggtgttggagctggggagcagggggactggagctgcgtggtaggaggtgccttctggcagcaggggtagggtgggctggagctgacagaggccaggacgtgaagcacttttgcacgggtatgggtgaggtgacgattctgaatggggtcaagcgctgtgaaataagcatgctctaggttgacgaagaaaggctggtggccgtgtctaaaggtctaacacatcacaggaaaatggctcccgtgggcctcctaacacacggagcacactcctcgcctctctggctggaccgacccacggctgcgtgtgtttaattgtccgaaacagaggtgaatcatccgctgtgagcgggacgcatgtgcgtctgtggtcctccgccttggaggctgtcagtcctgatgcctgctgcacagagctgagaagcagggcgagggcaaatgccctcaggtctaatcaggaaatattttcaattagtctctatcagaaattagaaaaaatatcaatgacatacccaagcaaaactaatgacatgcagacaccaaaacactttccaattcaaggcaccattccaccaggaaggagaacaagcatttgaggaggggcagaggtgcaagggaccctctccgcaggtgcaagtgagcagaggctgccacacactggaggctatgtaaaggtcaaaggacgcggctgcatctgctccgggtcgcctttcggggacatgttggccccaccttcctggacccttttcccaggaatcctttgaccttgactcctcagcctccccagcgagaatcctgcaagtggcgcttgacgtctcccctctcttccccaccatcagtgtgtgtttaattaggtctgggtgtgtctcgcggcccagggtggccagctctgtcctctgctctgcaggctggggctggaggtctgcagactacgcttcccaggctgccgtgcctgggctgccggcaggctctgcctgtagggggtgccagagggcacctggccggcctgcggggcgaggagggagctgcgggtttcctgcgccttcccacctcctcccttctgttccccggctttgcgggctgagagctgccctccgcacttattccactctctgtaagctcagcaccctcttctgttccttcagccttccacacccaagtaacctgctccccgtaactgtgttgaaatcctaagggcaatttcttttcctgaccatctggggcacatctattttacccacctctgtacccgtctcacaatcgcacacagcgggtactcagtaaacttctgcagaggagacgggcagacgcctccttgcggggcaactccactcagcccctgtccacctcctcctcgcaggagcttctaacctgtgtgcctctctgccttgattttctgtctctgtaatttggtcgccatcctgctaccacagctgtttttaaatcaatctgatgaggtcactgcagttgaaaagactttaatgagaccctggctcactgaactccatctggtttccagcttcctaacccagcgcccccaaactccccgctctttgaacaaaccagctctaatccctactatcaaacacgtattgttccttcttcccagctccccacctccctttcacctggcgcctcccagtcaccttcaggaccagcggaaatgcctgtgaccctgaaaagccagtgggcagccacccctcccccatcccacccaagctccaggctctgcagcctcacctgcatgttgactgccaggtataaagctcaactctgcacctggaggtggagggcaaaaaaggggctgtgaacagtcccttctttcccaggtggctctgtttgccctgatctgtaactgtcttctctgatccatgtggtgacaaaggtacacctgtgtctggtgcccagctggggctcatgcacccgatgtgggcatcactagtgcccagggctgtccccgcacaacaggagtgaggatttgagaccccgctggagaagagcccctgctcagtctgctccggggagaggggatccgaactcaggtgtgtgctgtccaccttctcaggtgggtgcacgtggaagtgatggaggatgagaactaaggctacctggccttgggcagcttcccaaagcccacttaacacagagccccgaacatttcagtctatccacacagcccagagtctgggatctgagggagatcgtgaagaggtcaacctgcctgggaccgggagtcagaccgcaagtcagttgtctctgggccctgcctgggcactgagggcccacaggatgtgagcacatttctgatcctgtgagtctcagtccccttccctgagaagcaccattgctcacacagacccagacagcagtgctgtgtggctgaaaggaaggcttggatcattagtatgagctcatccagcccatgcctccatctcctgccatcgggaacaaggtggggcagggcaggcatcaggggtctgtggacaagggccggggatttgcagaaacaccgtggagctctgagctgcctgttcctccaggtcccagccgggtctgctcacctccctttatatttagtggtttcctgcccagcacccactctccctgctccctctaccaatgtccttgccacatcctggctcctgaagggagcacacacacctctgaatttttccagaaagactcagaattacagggaagggccttctccctctgccttccttagacttggtagaaacagcaggcttgttactaccgaagtttgctgaatcaacttcctcctggacaaccctgcagatgagctggagctcccgctctgcgctccagaccctggggagagcccgccctgcggccccctggtcctgccgccacccccaggtaggttccatgcccacccagggctccagggtgccttactgcacagggtgaggcctgtgttcattatgactgtaattgcataaggaaatagggatgcagacaggaagagctgctcgttctgtgaaaaccaagttgaatgctttggaaagactcaataaaggagggcagccaagcagaaaccgctgccaagtcaagtccaggcaaggcaggtctaagagcagagaagaatcataaaaatctagggaaggtctgtctcccctggctggcttcccctggctggctccactttagaggaactgaatctgaaaatcattgatggtgtgatttccacaaactttctgcaagaaatacacccagacaggacaacagacccataaccaaagggatgaccacagccccaaatgagatgactggttgacagatgctcattagcatatctgacgtcaaagaaaaacgattgtgtgtccacatcatttttatgattgtctgcattagctgtttggatgaagttcctggtctgatagataagtagcacctactgtccagagacaattctgtggagcccaggcctcaaggacctcaaggttactgtgggtccccagagtgccctctccagcaggtgcagccagtgctggggtgaggcggagagaagacactggtgaacttggtgatgctgtggctcccatggggtggtgtcgtgtccctgaccagccagcaccgcttaaccagctccatgggcaaacccacagttaccacgcgatggaaggcacagtgccccctctgcactgtctaaaggaggtcaactctgtagggcagacagctacctaaatgacaataatgaaagatgaagttaataagcgcatgcctaatggagatacatgtcatagtagatgatattcctgaggctgcagcagctggcgaggaagtaagtgaagaagaaaacaatgtatcagaaaagtggaagaatgagatgacatttaaaaacaaaaaaaaaatgacattacagacacttaaatgatcaaaaaccttttctgctaaatgatgtcaatcaaccacattgtatcatcagaatgtcttttgccacgatttccacacatattagagtagctcagcttcatcagttctgacaataggcagaacgctttgcttctcatggatacaagcatgcattatgctagttccatcggcagttaatgatcccaaattgctgatccacagaaataagatgggagtttcaggttctttggagacttgttcttgctattcctagattcccaccagcactggacacatagcaaagcccctgagataattgctgactaactgaatgaatgaatgagtgagcaaagaagtgaacagatcagtaaacacaaaactgggactcttcctgaaaaatggttacggctggaattttgatcaattgtgtaagttgtcagcacatcaatcacaatagaaatcacagcctgggtccttcctgctaacatggaggagcagggagaggggctgggaaagtggggctgagacccgcacagtggagcagagttgccaggctgcagggctgccttgggggcaaattgggaagaggtgctccttcctgtgggaggtcagggcatggctgtcatcccctcagcccagcacccctctgtagggcgcagcacaacagggcaccagagaagggccgtgggggctggagctgtggctcggggggcttcccacaggttctttctgagaaaagaaattagttgattgggaaagggtggccgaagggcttacacacacttgcccacagtgaccttcctccttaattatgctccctttataaattagtgcttctcacttggaaggtctcagatacaaataaacaccagaaatgaagagttagtacaaccaaagccacaactgaatgcaagaaatgaaaacccgctcagaacaaagaggccgacatacaggaaggtaaagaacacagaaacagcagtgagcagtaaagcttctataaaattaaatctaaaggggtcatgaagatgtgaagggatgctgtgatttaagggctaaggaggagtgacatagaaaagacatcccaaagagcttacactctaacacatttcgcctggaactaaatgactttaaaccaccgcaggaaaacccagaagctggccatggtgtgggaggaggagggaagtgacgcactccaaagaaatgacagggtaagaagaaagtcatgctgaggaaagcacaaaacaccaagacacacagatgccaagagacgccttcttctctgggactagtggttgcctggttaatgaataagaaagttatttaaagtggggagtttcacacacacatacacatgcaaacataatacatacatactgaacccattttactttaacttaaatcctgtatatgtggagaaattcatagaaagacacaaactaccaaaacagacttgagaagaatagaaaatgtgacaagagattgaattagtaataatacaactacccgcaaggaaaagtgcaggctcagatggcttcactggtgaactctatcaaatatttaaagaagggccgcgcatggtagctcatgcctatcatccaagcacttggggagcccaaggagagagggtcacttgagcctacgagttcgagaccagcctgggcatcatagagggaacctgtctctacaaaaaaattaaaaaattagctgggcatggtgacgtgtgcctgtagtctcagctacttgggaggctgaagtgggaggattgcttgagcccaggaggtagaggctgcagtgaaccatgatcgcacctctgcactccagctggggggacagagtgagaccttgtctcaggaaaaaacaaacaaaaaaaaacatttagccgggtgtggtggctcacacctgttatcccagcactctgggaggctgaggcggctggaccacctgaggtcaggagtccaagacaagcctgcccaacatggtgaaaccccatctctactaaaaataaaaaaaataaaaaaataaaaaattagccggatgtggtggcatacatctgtaatcccagctactaaggaggctgaggcaggagaatcacttgaacgtgggaggtggaggatgcagtcagctgagatcaagccactgcactccagtttgggtgacagagagactccatctcaaaaaaaatttaatgaataattaatacaaattcttcataacaatcttccaacaaacggaagaggaagaaacacttccaaactcttctattaatatgaaaaggattacttatcataaccaagtgggatttatctcgcaaatgcaaggttggcttaacatcagaaaaatcaatctgtgtaattcaacatattaatagaacagaggacaaaaaccctatggtcatctcaatagatgcagaaaaagcatttgacaaaatccaactttctttttgataaaaaagacccaacaggctggacacggtggctcatgcctgtaatcccagcactttgggaggccgaggtgggcagatcacgaggtcaggagattgagaccatcctggctaacacggtgaaaccccgtctctactaaaaatacaaaaaaattagccaggtgtggtggcgggcgcctgtagtcccaactattcaggaggctaaggcaggagaatggcgtgaacccgggaggcagagcttgcagtgagccgagattataccactgcactccagcctgggcgacagagcgagactccatctcaaaaaaaaaaaaaaaaaaaaaaacaaccaacaaactaggaatagaagggaacttcctgaatctgatcaacagcatctatgaaaaacccacagctaacatactacttaatggtgacagactggatgcttcccctagatacaagctaagaaagtccactctcactgcttctattcaacatcgtagtggaggttccagccagggcaatcaggaaagaagacaagatgaaagacatccagagtgaagtaaactgatttctatttgcaggtgacatgattttgcatatagaaagaatccagagaaaagcccaacaacaataaagctcaaaatgagttcagcatggtttcaggatatgagatcaatataaaaaatcatttgtatttctatatattagcaatgaatgatctgaaaatttaattaagatagtaattccatttatgatagcatcaagaagaataagatactcaggaataaatttaacaaaaaagcaaaacttgcacactgaaaaccgtgaatataactgaaagaaattaaagaacatctaaatgaatggaagggtacctcatgtccataggttggaggacttactattgttaagatgacaatattcctgaaactgatccacagattaaccacaatcctcatcaaaatcccgggtggattgtttgcagaagttgacaaactcaacctaaagttcatatgaaatcaaagggcacagaatatccaaaacaatgttcaaaaactacagaactggagggctcacacgtccacacgtcaaaacttactatgaggctacagcaatcgaaaccatgtggcactggcatcaggacagacataggtcaatggaatagaattgagagtccagaaataaacacgtatatctatggtcaattgagtctgactaatgttaccaagaccattcaacggggaaagattcattttttcaacaaatggtgttggaaacagaacaaagctggacccctacctcacacagtgtataacaatgaactcaaaatggtctaaacacctatgtgcaggccgggtgtggtggctcacgcctgtaatcccagcactttgggaggctaaggcaggctgatcacaaggtcaggagtttgagaccagcctggccaacgtggtgaaaccccgtctctactaaaaatacaaaaattacctggggtggtggcacacgcttgtaatctctgctactcgggaggctgaggcaggagaattgcttgaacctgggaggcagaggttgtggtgagccgagatcacaccactgcactccagcctgggtgacagagcaagactccatcttggggaaaaaaaaaaaccaaaaaaccctaagtgtaagagctaacagtaacactataaagctcttaggcattgctttcttagatgtgacaccagaagcacaaacaactaaagaaaaaagcagagaaactgaacttcatccaaattgaaacttttgtgcatcaagtgaaaagataacccacagggtgggagagaaatttacaaattatatatctgataagggggttgtgcctgaaatacagaaataacttttacaactcagtaataaaaagacaaataacccaattttaaaaataggcaaaaggtctgaaaaacatttctgtagggaaaatatacaaatagccacaagtgcatgaaagtatgttcaccatcattaattatcagggaaatgcaaatccaaaccacaatgaaataccacttcaccaccactacgatggttataattaaaagaaagatcataagtgttggcgtggatgtgaagaaactggaaccaaaatgaaataccacttcaccaccatgatggttataattaaaagaaagatcataagtgttggcgtggatgtgaagaaactggaaccaaaatgaaataccacttcaccaccatgatggttataattaaaagaaagatcataagtgttggcgtggatgtgaagaaactggaaccacaatgaaataccacttcaccaccactaagatggttacaattaaaagaaagatcataaatgttggagtggatgtgaagaaactggaaccctcatggtctcacggtgggaatgtaaaatggcacagctgctttggaaaacaatcttgcagttcctcaaaaacagaatcatccttatgacccagcaattcccctccaaggtatatactcaagataaattaaaacatatgttgacacaaaaacttgtacaaggatgttcataacagcattattaataacagccaagaaggcaaacagcccatatgaacatcaactgatgaataagcaaaatgtagtatactgatacaacaggatatactgttgagccgtaaaaaagaatgaaatgttggtacatgtagaaacatgaatgaaccttgaaaacatcatgctaaatgaaagaagccagacacaaacggccacatgttgtatcattcaatttatatggaacatgcagaacaggcaaatccatggatacagaaagtagattagtggtttcctagggctgagaggtgggaaggaaatagggtgactgctaaaggctatagggtctctcttggggataataaaaatgttctaaaatggattgtggtgaaggttgtacaactctgtgaagatattaaaaccgctgaattttaaatggaggaattgtatgataggtgaattgtatctcaagacagctgttacccgatcccccatctcacagatccctggtaaaagaaaaaaaccatttataaagtgtccctctgaatccacaaggaattgcttccagaacctcctctgccactggatactaaaatcggtggagggtgaagtcttttacataaaataatgttgtatgtggacataacctacacacatcctcctgtatactttgaatcatctctagaatacttctaacacctaatacaatataaatgctatggaaatagttgttatactgtattgttttttatttatatttttgttgttgttttgttatttttattgtgttttttccttgaatagtgtcgatccacggttggctcagtgggggctgactgtacatacatggactgacctttttctgcctgagtaaagccttttctgagagtcagtctgctgtgtggagtgcctcgtggtctttcctgcataagctgcatccataagacatgaatctaacaacccttttctgtgtttttaaagtggggctagagctgaaaggcacttgtcaagcaatgtgtatgtggactccctccagatttttttttaatttttttttttttttaagtctcaatctcgctctgtcgcccaggctgtagtgcaatggcacagtcttggctcactgcaacctccgcctcccaggttcaagccaatttcctgcctcagcctcccgagtagctgggattatcggcatgtgccaccatgcccggctaatttttgtatttttagtagagacggggtttcaccatgttgaccagggtggtcttgaactcctgacctcaggtgatctgccggcctcccaaagtgctgggattacaagcgtgagccaccaggcccggctcctctagatttttatcagcatttatcgcaaccgccatagttgtctcacttgcatctaatggacagcaatacattcagcagcaccccctttcaccgaacctttccaaagaactcgactgtgctgtaccagaaacaattatctttctgcactcatatttcatggctttacatagtactagaatatgtaattacaacaaatatcactggcataaactagttaggaatagctacaactgtcccttggaaagctcatggcccagcttcctggagcagaaatggcgcaggggtgaactgcggaagctactggtagggaatggttcgcacagccagcctggctcaagcctcggcccacatggcaagagccgacctccatgtggccaccacgttccttcaaatcccattcccacagatgagcggactcatcccatcagcagctctgtgaggacagcagggcacacgcttcatctttagagccgaggaaacggggtcccacaggcagtgatgtgcccaagattgtgccagtcccatagggcgccatggccaccctctgaatccacagggaagtgtggattcacccaccaccagctctcttttgcctcgcccatgactctcaagcccggcagcagagccgggggtctcatcacgagagcagagccttgggctcccgcggtacccgtcacagaccggaaaggatgtgctggcaggaagccggatatttctgcttccaagccagggtgtgaggcaaactcacccacaaagtactcagcgaggaaacaacagggcttctgacggcagccgctgtcgccgcagcctgcctttcccttgcacagtattttctgctggtaaagagcctcagcccaccgcgtctgcagacattgctgcgacgtcccagtgacagactgatattccctacacatttcaaatccaacacatcacacgtattagggatctccaggcatcccattcattccacttcacaggtgaggaaactgaggcacaggtaggttcagtgacacacccagagtcacctgcctcgaatgcagaagaggtgggactcagaccctggagcgcctggcttgagaagcacggctccacgcctgctcatgccccacccatcacaactacagagcgactctgcacactgctgttatactcgtatatgctcttataaagagaatttactttattcttatttagttggcaattttcattttaaagcataaaaccaggagaatgcaaacttttagcatttacatgcctttagttctgtaagtttggtcaaatggatgtgatatttacagatcaatagtaaaatctgctgaggtgaggagaagcccctggtacttaacctttcctttacagaacacgttggagaaaattgccaacatgaggccccgatgaacaagggcagaagttcaaggctaccttagaactgcttaattagatacctttcagaaagggcagcctggctgtgacagctgtgtggatatacaccgggagggagagactcccatggcatgcaattaggaccaaagaatttttaacgtcttggtaatgatgctctctggccctgtatcttgattaactggatgttgactgccacagggtgaatgacaaagaagagcacattaaaaaaacccactataagaaccagctgccttttcttgcataagatgcataaatcattgcgtgggaagcagcgtaggtctcaaaggggcaaattgagagacagagagacagaaagagaccgaggcagaaagacacacacagagacagagagagacagacacacactcatacacacacacacgcgtgcgcatagatattcctacccttaccatggaagaacaatattttttcatcaatttctctttgttgtactcagtagcattctgatcagtaggctgtgttccattcacattgaaacaggaagagcgttcattatttatgagatgtgtatttataaatgtgtattaataacccacatattataacatgtgttagtgaaccatgctccgggcctcctcgctgcccctgggagtgacaggtcttcttgtgtatgaccctgggcaaagggtcaaatgatggccagtgactggcctctggagtatgagctcagggttcattagcaaatcaaaaatgcacaggttagcaattttccaactggaaaagaactgatcttctaacacctctaaacttcccggattaaaagagaattctgaagcccgaggaaggcaccttgctttggaggtgctgggtccaggggatgtccagggctgcaggaatttcactacatgactcaagggcacatgccaggggccatcctagagaacacgacagtggcagaaccctgtcaatatggagctccaacaacacctaaaataaatacatcagcggcgccacgtgtgcagatgcttggtcttccagagggcaacacaaggtggcctccaggtgccatggactgtcaggggccgctgtcctcacagcatctggctgaagccagaagcgtccactcctacactggtttcaaaccgcgcagaggaggaggggatcaggccactcaccatctgcaggacatcggaggagaccatctgcatacagcacatggctgtggccagcgcacacacgatagtggacaggacgttgagggcacacacgctgaagaggagatcctgcgaggaaaggtgcaggagaatgtcagcctcatcccgaaatagatagcagaatccttagccctcctgccagggcccagaatgagccgaggtcgatgaccatccacttcatggaggttttgttttgtgtgtgtctgtgttttcctcataatcaaaattggcctttcatagaaacacattcgtttattccgttacaatgatgagcaaagtattcataatactcaacaatgtgttttacaattttgataattattaggtagtcagtaacatgtctaaggaaatcataaggtggccaacatttaaggaggtgggccatttttatcaaacacaacctataactcaagtgaaactttttatcttgagataattgtatattcacatgcaattgtaagaaatcctacagagagatcttgggtaccctttactcattctcccttaatggtaacatttggcaaatctatagtacaatatcacagccagatactgacattggtatagtcaggatgcagaatagtcccatcaccacacgggtccccccagtgttgaccttttatagacacactcacctccctttccctgctccccatttaacccccagttctgatcccctgtcaatcgctagtctgttctccattttttataattttgtcatttcaagaatgttgcataagtggattgcacagcatgtaacctttcagaattggctttttccactcagcataattccctttagactcatccaggttgttgcatgtatcagtagttgacttctttttattgctgagtggtattccaccatatggatgtaccacattggtttaatcctcaacaactgaagaatatctggttttttggtattccagttttccagttgtgggctattacaaataaagctgttgtgagcctttgtttataggtttttgtgtgaacataagtttttgtttctccgagataaatgtccaggagcacaattgctgatttgtacagtaattgcatgtttagttttattttaaaaactgaaaaaatgccttccagagtggctgaacaatttttaattcccaccagcagtgtatgagtgattgggtttctctgcatgattgccaacatttggtgtcactgtttgtgttttagctattctcataggtgcataatgatactcctttataaaatgttttattttgcatttccctgatgctaatgatgtcgaacatcttttcatgtgcttatttgccatctagagatcctctttggtaaaatgtctgttcatgttttttgcccattttctaattgattgtaatgtttacttttttttttttgtagtgttgagttatgagagttctttatgtattctaggtactagttctttgtcagataggtggtttgcaaatattttcccccagactgtagcttgtcttttcatgtttcacatagagtcttagtcagctcaggctgctattacaaaaataccatagaccaggtagctctaacaacagtcacttctcacagtcctgaagtctggaagtctgagatcagggtgccagcctgttggattctggtaagggcctgcttcctggttgaagatggctaatgtctcactgtgtccttgcttagtgaaaagagggcaggggagctctctggtgcctcttttaaaagtgtattaatcccatcatgtggaatctaccctcatgacctaacaacctcccaaaggccctgcctcctattaaataataacatattgggaattagaatttcaacatatgaattttggagggacacaagcattaagtccattatatctgagtttttaaagaacaaaaaattttaatgttcttgagatccaactgatcaacttttgttccatacttttggtgtcaagtctaaaactttgtcaagccccagattgtgaacagtttctcccatttttttctgaaagtttttatagtttcatagtttgcatttaagtctatgctccatttttgttctgagacagggtcttgctctgttgcccaggctggagtgcagtggcacagtcatggctcactgcagcctcgaccttctgggctcaagtgatcctcccacctcagcctcctcagtaactgagaccacacatgcataccactgtgcccagctaatatcatccattttaagttaaattttgaataagatgtgagttttaggtttaggttcctttttatgtttttaatttcattttccaaatgttgttagtacatagaaatgtgattgatttttgtatgtctatgtgatatcttgagactttgctgaaattgatatcttgggactttgctgaaattattagttctaacaattttttgaagatgccaggggattttctgtgtagacaatcaggccatctgcaagtgttttattgatttccttccattttattaccttttattattattattgttctttttttttgcctcgtggtgctagctagaaccttgagcattataaataaaaatataagatgactaagatcatgaaagcagacatctccatcttgtgctcttagagggtaaacttgatggagttttaacagtcgaagtgcaatatagccttcattgagaagcttactctcaaatccatgtcagaaatagaaaaaaaaaagatttagaatgatagtatgtccttcaattaaatcttttcatatacaagtgtacaaaatactggacacactcaaaaagctatcagaaaacatgaatctttcaccacaaaggctatggcattaatcagattagtttcagttatctaatcaaggggttggcaagtgctcaagaggagacggggaatgccaccctcactgacatgctctgtgcgtgtgctaggatgtgggcacacagagtctagcagcatcctcagggctcgttcatgtatacatgagcccatgtgttccaatctgtaacatcctctggacaattccctgttctcctacaaacatcactgcccaatccccttcctcagaagctgctcatcagttctcaagcccacactgtgaaacagtaaagaagtgtgattaggataatatcatggaaggtggttaacatacagtgtttaaacactttcccaagtttatagaaccccatgcacatgtgaaggcagaaaaatgagtcctgaacttaagaagcgttaggcagaaccggccgggcgtggtggctcatgcctgtaatcccagcactttgggaggccaaggtgggtggatcacaaggtcaggagatcgagaccatcctggctaacacggtgaaaccccgtctctactaaaaatacaaaaaattagtcgggcgtggtggccggcgcctgtagtcccagctacttgggaggctgaggcaggagaatggcgtgaacccaggaggtggagcttgcagtgagccaagatcgcgccactgcactccagcctgggcaacagaacgagactccatctcataaaaagaaaaaaaaaaaaaagaagaagcgttaggcagaaccaaggcaaggctcagtttagggctaactattccccactttggaggtaaggcctatccgagtccctgaatgatgtgggaacaggcactgttcctgtgtgagcaccaggcactgttatcactaatcctttcaggcagttcttttcccagactcaggtcgtttcttcatatgcacgtgctaaccagcatccaactgacaactccaggcagaccctctgaagacccccatgtttctctcctggtgcagctctgccctcgatggtgctctgtcctaagaactcttgtctccaggccttgatccccctcagactctcagccctctacgcccaccccagggagtctgcagggaccctgctgtgttccctttccagcactgaacctggaaactgtctcaaggcagtaagctggggcaatcgtagggctcacctcatttatcacccacccctcagggatcagggttcttcattgcctgatagtgtcttcctacactgtgttcattttggggggctgtttcaggcaggaggttaaatccaatgtcctgctactccatcttggccagaagctcttggtggcttttttgtttgcgttttctaatgtttgtagcaggactaggcggactgccttagggatcctactataggcatctccactgccctccctgctcctacagctgctagacatggagcaggatgggggcttagttgtggcaaacagcaggcacaggtggggctggagggaggctgaggagcctagattgtattttgcaggtaatggaatgccactgaagatgtgtgatgctgggaaagaggtcatacaacctgttttttgttgttgttgttgtttgtggtggtggtggcgtttttgttttgttttgttttgtttttgagatggagtcttgctccagtccatgctggagtgcagtagcgtgatcttggctcactgcaacttccatctcccaggttcaagcgattctcctgcctcagcctcctgagtagctgggtctacaggtgcccgccaccatggctggctaattttttttgtatttttagtagagatggggtttcaccatgttggccaggctggtctcgaactcctgacctcaggtgatccaccctcctcggcctcccaaagtgctgggattacaagtgcaagccacggtgcctagcccatgcaacctgttttgagaattgattgagaaagacacctttgcagggagggcctagcacagaactatagatggagtaaacatcggttgaagtgagactggacacagggcagtgacccgtgaggcggtaccggagaggagtcaagcagagcccaggaggaggcatgcagatgccggtctgagggtgactctgaagttcagaacaaaagggcgtggctgtttactggagtaggggagaccgggatgagggtgcagatatagtagaaagatgattctggtgagtggaaacatgagatgcctgcgcgtgggccagggactgtgggagagaagcagtcttaacgaacacctcagcaggccaggcgcagtggctcatgcgaggcgggaggatcacttgaggtcaggagttcgagaccagtctgaccaacatggtgaaaccccgtctccactaaaaatataaaaaaattagccgggagaggtggcacatgcctgtaatcccagctactcaggaggctgaggcaggagaatcggttgaacctgggaggtggaggtagccgtgagccgagatcatgccattgtattccagcctgggcgacaaagcgagactctgtctggaagaaaaaaaataaaaaataaaacacctgaagtggtctgggacatgtggaggctgagttaccagtgggcctgacccactgagatgttggcaaatggttggaaatttggggctggggctgacgatggagatcagaactggaggtgtggaccaggagtcatccctacagagttcaaatgtgccttcaccttgcggatgtccttgatgtatctgcgggcccctgtgtgtcctcattcccctctccagatccatcagacttcaggggcctgggggcctccgcaggctccctacagaagagggcatttctttgatgaaattaccattctcacctcaaagatacacctcagcatagttttcctctaagtgacatgaattttgtgctggattctagaaaactgacagatttatccatgtgcgcagtagctggctgagtgccttttctctcctgtgaggaagagcttctaaaatgtcttaaggctcagccagaagctttagcacatttttgagcaggaagttggactcactgtagtcttaaaacaatcctgctggtgaatgaagtcataattagaactcttaagtatgtattttatatatctcaggagaacaattcaaagttataactaaaatagcgacatcttttttttttttttttgagatggagtctcgctgtgtcgcccaggctggaatgcagtggcgcgatatcggctcactgcaacttccacctcccaacttcaagtgattctcctgcctcagcctcccgagtagctgggattacaggcatacgccaccacgcccagctgatttttgttatttttagtagagacggggtttcaccatgttggccaggatgacctgaggtgatccagccgccttggcctcccaaagtgctgggattatagacgtgagccactgctcccggccaatagcgacatctcttaatgtaccattgctaaaatataagcaatacctttactttgtcctcaatctagaaatttcaactttattgaccacataatccactgtcatttaaatgaatgcctttctacaaataatattaatttcgcatatgctaccaaatgaaactactcacagacagaaacaccaactctgacctctgtttgcatacgcatcatgaggcagcctgctttacgtctcatgaaaggtattcatttgaaatacatgccagaaagacttttcccctccagctgtttaaatacttgatgtttttctaagtaaccgcaaaccacctggtattgcgtttatgtgtttcttcagaattcttttttggcttaaatgacattatctctgccttttttttttttttttttgagatgtagtctcactctttcgcccaggctggagtgcagtggcgtgatctcggctcactgcaacctccacctcccgggttcaagggattctcctgcctcagcctcccaagtatctggactacaggagcacgccatcactcccgtctaattttgatgtatatttttttaagtagagatagggtttcaccatgttggctaggctatctctgctttttgaaagttttatcagagtcctttacaaatactgaaatccacattctataaaattcctttacaaggtgattcaaaacggcgaatatgagagagaggcgggtctttcattgctgatactgagttttgctactggatattctgatgttattagctttttgatgttattaatgttataaagttaaggaagttatgtatctaataaatgatgtatagaacaaaaacaagagaaaaaagttttagatacttgggcaaagctacagttgataaattattttgaaaatctctccagtctacgtaagttatggatattaataataagattaacagagaaaagcgacagcaatgacaatgtacatacatatagcctacacgttaaaaacattaaacagttcaggacattgagcgggtcgtggtagtgtatctggaattggtgggttattggtctcactgacttcaagaacgaagctgtggaccctcgcgctgagtgttacagctcttaaaggtggcgtgtctggagtctgttcgttctgatgtgtttggagttttttctggtgggtttgtggtctcgctggcctaggagtgaaaccacagacctccgcggtgagtgttacagctcttaaggcggcgtgtctgaagttgctcattcctcccgataggttcgtggtctcgctggctccaggagtgaagctgcagaccttcacggtgttacagctcataaaggcaaggtggaccgagagagtgagcagcagcaagatttattgcaaacagcataataacaaagcttccacagcatagaaaaggacagggccgggttgctactgctagcttgggcagcctgcttttattcttatctggccccacccacatcctgctgattggtccattttacagagagccgattggtccattttacagagagctgattggtccgttttgacagggtgctgattggtgcgtttataattcctgagctagacacaaaagttctccatgtcacaactagattagctagatacagtgtccacacaaaggctctccaagtccccaccagagtagctagatacagagtgtcgattggtgcattcacaaaccctgagttagacacagggtgctgattggtgtgtttacaaaccttgagctagacacagagtgccgactggtgtatttataatcccttagctagacataaaggttctccaagtccccaccagactcaggagcccagctggcttcacccggtggatcccgcaggtggagctgcctgccagtaccgcgctgtgcgcctgcactcctcagcccttgggtggtgtatgggattgggtgccatggagcaggaggcggcgctcgcccgggaggctcgggccgcacaggagcccacggagacgggggaggctcaggcatggtaggctgcaggtcctgagccttgcccagagggaaggcagctaaggcccggtgagaaattgagcacagcagctgctggcccaggtgctaagcccctcactgctccagcaggcagggccagctggccactcccagtgcggggccgcggagcccacgcccacttggaactcctgctggcctgcaagtaccacgcgcagccccggttcccgcccacgcgtctccctccacacctccctgcaaggtgagggaaccgactctggccttggcaaacccagaaaggggctcccacagtgcagcgtgggctgaagggctcctcaagtgccgccaaagtgggagcccaggcagaggaggcaccgagagccagggaaggctgcgaggactgccagcacgctgtcacctctcagtagctcacacctgtaatctcagcacttttggaggctaaggtcagatcatctgaggtcaggagtttgaaaccagcctggccaacatgatgaaaccctgcctctactaaaaatacaaaaattagccaggcgtggtggcaggcacctgtaatcccagctactcaggaggctgaggcaggagaatcactcaaacctgggaggcagaggttgcagtgagccaagatcacaccaccgcactccagcctgggtgacagagtgagactctgtctcaaaaaaaaaaaaaaaaaaaaaaaaaatcaggacgttgatacctttgcttgctggacaaaatgaggacaaactatcttacatttatttccgctagttcattcagtagtttttttcctatgtcttctctctttgaataggagagaggtctcatgggaacctattatcagtcaagatataatgatagaaggtatgatgataaggagagttccacagcataaaacacaagcggaagaaatatccagcaatagctgtatatgtggtaataattataagggatgggtgttgggctttatctgaattattatcttaaatgcccacaccatttattctttgttgccttgtgatggtagacattggtcatggacctgacgttccgtgcagatctatgttgggagaggcagtctgccatgggccctgagcatgccctgaagttcctgctgggtatgccaagaatgtaaggccttgactgctctttacctgacccatttcccagggctgtgtttgcaccaagaaaccttgaggaaggaggtaacgtctcccctagacaaagtgtaggttctctacaaagacagggattccccaagctcagtgtttctgccccataacgcagctcaccacacatgtgcaggcatccgtggtgggcccttagcatcaccctgagaccccagggcatggggaactgacacacactagcctagagctctggctactgcttttgccatgaataataaagtcccttgtctctgaaccaggaatctcatgtctttttgccaggaaagtaacagtaaacagtaacagactagtttgttagcttgaaagtaggttaaaagctcagaccctgcagttcctggcagtttatttccatctccatcttgtaagaacatcaagagcagagaccaagtcttttgctactctgtatggtagaatatcttattcaaaataggtggttgctaaatatttgaaattttacaggctcattgttctcttctgaattgtaagttcagactagaaggaaatgcataatttccaagcttctaaccacacacagaaaattcaccttcacctttaagtaaagtaatgcagcacacataggatcatggtggacgggaggcaggactagattgcagctctgaacagagcaatgtgcagaggcttgcattgtgaattttagctccagatcgactgcaagaacaaaccagcaaccccgagaggaccgacagacctctgaaggaagcagactgctcttgcaggacctggaagacaccccaaatactgtgagtgcccaaactgcggaagtgggaaagggagagcatcctctcccaaacacacacgcccactggagaaaaggaaggtctgtttgcaggagaagtttccgaccttacctggagctgagtcaatttagagagtcgagcgaaatacagaagtagaggaagcagcgggaaaggccctgggagctccctgggtccccaagcaggtcattcctgcctggcaccacagggatccaccaggagggcagccagaggagcgagggtaaaactcaacagggagaaggaaatctctagctgaaatttgtaacaatttgaacagggttagaagcctcctggccagaactcgggggagggcgcaaatctggtgtgcagattctccacaggtgggaagaacaagccctttcttttgcagctgggaggtgggtagcctgaggcaagttctcaagcctgtctcacccactgcccgaaaacagacttggggcggttggatgggggcatggtgggagtgagactggactttcagtttgcatgggagctgggtgaggcctgtgactgccagctttccaccacttctctgaaaacctgcatgactcagcagaggcagccataatcctcctaggtacataactccagtgacctgggaatctcacacccatcccccacaggagctgcagcaagaccggtccaaagagagtctgagctcagatacgcctggccccacccccacctgatcgtccttccctacccactctggtagcagaaaacaaaggacatataatcttgggagttctacagcccagcccacagccagtccctctcaaactactacagctgatgctttctggaaagcgccacctcacagcaggaggccaacccgcacaaaaatagagcattaaaccaccaaagctaagagccctcacgaagtccactgcacaccccccaccacctccactggaacaggtgctggtatccatggctgagagacccatagacggttcacatcacaggactctgtgcagacaaccctcagaaccagcccggagctgggcagacttactgcgtggccagacccagaagagagacaacaatcactgcagttgggctcacaggaagccacctccataggaaaagggggagattactccatgaagggagcactccatgggacaaaagaatctgaacaacagccttcagccctagaccttccctctgacagagcttaccctaatgagaaggaaccacaaaaccaatgctggtaatatgacaaaataaggctcttgaacagcaccccccaaaatcacactagtttaccagcaatggatccaacccaagaagaaatccctgatttacctgaaaaagaattcaggaggttagttattaagctaatcagggaggcaccagagaaaggtgaagctcaatgcaaggaaatccaaaaaacgatacaagaagtgacgggagaaatagccaagaaaatagatagcttaaagaaaaaaaaataaataaaaaatccaggaaaaattggacacacttatagtaatgcaaaatgctctggaaagtctcaggaatagaattgaaaaagtagaagaaattcagagctcaaagacaaggtctttgaattaacccaatcccacaaagacaaagaaaaaagaataagaaaatatgaacaaagcctccaagaagtctgggattatgttaaatgaccaaacctaagaataaccagttttcccgaggaagaagagaattataaaagcttggaaaacatatctttaggaataatagaggaaaacttccctggccttgctagagacctagctatccaagtgcaagaagaacaaagaacacctgggaaattcattgcaaaaagatcattgcctaggcatattgtcatcaggttatccaaagttaagacaaagtaaagaattttaagagctgtgagacagaagcaccaggtaacctataaaagaaaacctatcagattaacagcagatttctcagcagaaaccctacaagctagaagggattggggctctatcttcagcctcctcaaacaaaacgattatcagctaagaattttgtattcagcaaaactaagcatcatatatgaaagaagatacagtctttttcagacaaacaaatgctgagagaattcgtcactaacaagccaccattaaaagaactgctaaaaggagctctaaatcttgaaacaaatcctggaaacacatcaaaacagaacctctttaaagcataaatcacacaggacctataaaacaaaaatacaagttaaaaggcaaaaacaaaaaacaaaaaaccaaagtccacaggcaacaaatagcacaatgaatgcaatggtacctcacatctcaattccaacattgaatgtaaatggcctaaatgctctactttaaggatacagaactgcagaatggataagaactcgccaaccaactatctgctgccttcaggagactcacctaacacataaggactcacataaagtaaagaggtggaaaaaggcatttcacacaaatggacaagagagtaggggtagctattcttatatcagacaaaacaaactttaaagcaatatcagttaaaagagacaaagtgggacattatataatagtaaaaggccttgtccaacaggaaaatatcataatcctaaaaatatatgcatctaacactggagcgccaaaatttatacaacaattactaatagacctaagaaatgagatagacagcaacacaataatagtgggggacttcaatactccactgacagcactaggcaagtcatcaagacagaaagtcaacaaagaaacaatggatttaaactataccttggaacaaatggacttaaaagatatatacagaacatttcatccaacaacctcagaatacacattctattcaacagcacgtggaaatttctccaagatagactatatgataggccataaaacaagactcaataaatttaagaaaattgaaattatatcaagcactctctcagtggaatcaaactggaaatcaactccaaaaggaaccttcaaaaccatgctgatacatggaaattaaataacctactcctgaatgagcattgggtcaaaaacgaaatcaaggtggaaattaaaaaattcttcgaactgaacgacaataatgacacaacctaccaaaacctctgggatataagcagaggtggtgccaagaggaaagttcatagccctaaacgcctacatcaaaaagactgaaagggcacacactgacattctaaggtcacacctcaaggaactagagaaacaagaaaaaccaaacccaaacccagcagaagaaaggaaataaccaagatcagagcagaactaaatgaaattgaaacaaacaaacaaacaaaaatacaaaagataaatgaaacaaaaagatggttctttgaaaaggtaagtaaaactgatagaccattagtaagattaaccaagaaaagaagagagaaaatccaaataacctcattaagaaatgaaacaggagatattacagttgacaccactgaaatacaaaagatcattcaaggctactatgaacacctttacacacatcaactagaaaacctagaagagttggataaattctggaaagatataaccctcctagcttaaatcaggaagaattagataccttgaacagaccagtaacaagctgcaagactgaaatggtaattacaaaattaccaacaacaaaaaatgtccacgaccagacagattctaagaagactttctaagaagaattggtaccaatccttttgacactattccacaagataagagaaagaaggaactctctctaattcattctatgaagccagcatcaccctaataccaaaaccaggaaaggacctaaccaaaaaagaaaactacagaccgatatccttgatgaacatagatgccaaaatccttaacaaaatattagctaactgaatccaacaacatatcaaaaagacaatacatcatgatcaagtgagtttcataccagggatgcagggatggtttaacatatgcaagtcaataaatgtgacacatcacataaacagaattaaaaacaaaaatcacatgatcatctcaacagatgcagaaaaagcatttgataaaatccagcattgctttatggttacaattctcagcaaaattagcatacaagggacatacctcaatgtaataaaagccatctatgacaaaaccacaggcaacataatactgaatggggaaaaactgaaagcgttccctctgagaactgaaacaagacaaggatgcccactctgaccactcctcttcaacatactactgaagtcctagccagagtaatcagacaagagaaagaaatacagggcatccaagttggtaaaaaggaagtcaaactgtcactgtttgctgacgatatgatcatttaccttgaaaaccctgaagactcctccagaaagcttctataactgataaaagaattcagcaaaatttccagatacaagatgaatgtacagaagtcagtagctcttctatacaccaacagtgaccaagccaagaatcaaatcaagaactcaaccccttttacaatagctgcaaaaaaataaaatacttagaaatatacctaaccaaggagtcaaaagacatctacaagaaaaactacaaaacactgctgaaagtaatcataaacaacacaaataaattgaaacacatcccaggctcgtgaatgggtagaatcaatactgtgaaaatgaccataccagcaaaagcaatctacaaattcattgcaatccccatcaaaataccaccatcattcttcacagaattagaaaaaacaattctaaaattcatatggaaccaaaaaagagcccacatagccaaagcaagacgaagcaaaaagaaaaaatctggaggcatcgcactacctgatttcaaactatactataaggccaaagttgcaaaacagcatggtactagtataaaaataagcacatggaccaatggaacagaatacagaacccagaaataaaccaagtacttaaagccaaccgatctttgacaaagcaaacattaacataaagtggggaaaggacactcttttcaacaaatggtgttgggataatcggctagccacatgtaggagaatgaaactggatcctcatctgtcaccttatacaaaaatcaactcaagatggattaaagacttaaatctaagacctgaaactataaaaattctagaagataacatcggaaaaacccttctaggcattggcttaggcaaggatttcatgaccgagaacccaaaagcaaatacaataaaaacaaagatcaatagctgggatcaaattaaactaaagaggttttgcatggcaaaagaaacagtcagtagagtaaacagacaatccacagagtgggagaaaatcttcacaatctatacatctgacaaaggactaatatccagaatctacaacaaactgaaacaaatcaataagaaaaaaacaaagaatcccatcaaagagtgggctgacatgaacagacaattctcaaaagaagatatacaaatggccaacaaacatatgaaaaaatgctcaacatcactaatgatcagggaaatgcaaatcaaaaccacagtgtgataccacgttactcctgcaagaatggccataatcaaaaaatcaacaaacagtagatgttgacatggatgtggtgaacagggagcacttctacactgctggtgggaatgtaaactcgtgcagccactatggaaaacagtgtggagactccttaaagaactaaaagtagagctaccatttgatccagtaatcccactactgggtatctacccagaggaaaagaattcattatatgaggaagatacttgcacacgcatgtttatagcaacacaattcaattcacacttgcaaaattgtggaaccaacccaaatgcccatcaatcaatgagtggataaaggaacggtggtatatatatatgatggaatactacttagccataaaaaggaatgaagtaacagcatttgcagtgacctggataagattggagactcttattctaagtgaagtaactcaggaatggaaaaccaaacatcgtacgttctcattgatatgtgggagctaagctatgaggatgcaagggcataagaatgatacaaaagcataagaatgatacaatggggagaatagtgggaggcgggaaagggataaaagactacaaatagggtgcagtgtatactgctcgggtgttgagtgcaccaaaatctcacaaatcaccactaaagaacttactcatgtaaccaaataccacctgtaccccaataacttatggaaaaaaagaatttaaaaaaacctactacacatagttacaaacccaataaagaaagaaagtaatgcagagaaagactctgtacaaagactcttgttggtagcacaatcagcgtgtgtgtgtaaaatctgtaatttaaattttccacgaaatttctagagtgatgagacacatcctggggcagatctaggactgtttaatttgtctctgtagaaagcagttatagtctacagaggtctttgtggcgggcttaaatactgatcctacaaaaggagctaaaattaggctgtcatatggagaaggtaagtgattcatagagaaatctgtgaagctataatttcaagaggcaaacatccatttacaatccctaaaaatgtcgatggattttggccttgctttggccactcaggcaccaccagtaacacatgtgctgctctaagaaggcaggattgctccccacatggtgcctgctgtttgctcaatggcacttttaactctgggcaaggacccaggagggagttcacacactctccgcaagggttcagaactgcaccctatttgataattgaaaacctggcttttgtcatctgaaacaatagcttttactctttagtggatggctgtaaattgcctacatgatcatctgtgtaaataatcgtagactaattattttcttacagttctacgaagttttaagaagaaaactatttgccatttttctgatattcaaggcaaagtaatgaggcaaaaaaagtttctgtgtgtatacacacttttgtatctttgtgtgtgtatatatgagatagattatacacatacatgcatatatacatacagaaatctttcctataaattctggatttctgaagactcactgtgatcctaatgagcctctagctttaaaacaatgttgaacaaaacaccatttttaaatatttggctttaacctaaatttatgggaatgaagaaaataaacaagcattgtcaagaacattttgggaaaaaaaaggctttgcacacatcaaaatgtaccctaaatctacaataatagtatagggtggcatcaataagggacagaatagagatcctattataataaaagaagtacaccacattacttgtgttgggataattggctgtctttaaaaaacaagtaagacagatctagatgtgaaaagaagagaggaaaattcttcctcgtgaacctagatgcaaaagtcctaaataaaatattgaaaaattaaatacagtagcattttaaaaaacatattatgaccaaatgtggtttattcctatattacaaggatgttttaacataatgtaatttattaatggaattcactacattaaatgagaaaaactatatgacaatctcaatagatgcaaaatagcagttggtatttcaacactagtgtaaaagcctctaataaacttgaaatagacaggagctccctaaactcaagaaaccctacagcaaacatctggaaggagatggggattgctgccaatatcacttctgttctacacaggtcccagtcattggaagaagacaggcaaaagaagtaaagtgtgttcaaactgggaaggaagaaaaactgtccaagatgatacaattattcatacagaaaactcaataacatttccaaatatttagaactaaatataatagttgtgcaatgttgctgcatataaaatcaatatgcaggccgggtgcggtggctcatgcctgtaatcccagcactttggagggccgaggcagggggatcatgaggtcagaagattgagaccatcctggctaacatggtgaaacccccatctctactaaaaataaaaaaaattagccaggcgtggtggcgggtgcttgtagtcccagctactcaggaggctgaggcagaagaatggcgtgaacccgggaggtggagcttgcagtgagctgagatcgtgccactgcactccagcctgggtgacagagcgagactccatctcaaaaaaaaaaaaaaaaaaaaaaaaatcaatatgcaaaattcattcactagcaacaaacagcaagtataagttttttaaagatacgatttacaatagcaaaaaatgtaaagtagccaagaataaatatagaaaaaggtggaaaaatgtgttgagaacaaataaataatgagatcttgtagtcatgaataggaagattcaatactataaatacattaattctttccaaatcaacttataaatccaatggaattccaacaaagaccacaacaagactgtgtgtgtgtgtgtgtgagtgtgtgtgtgtgcatagtctgtgacaggatcattttaaattcctcatctcccttctctctcccacccctgctgccccacaccatgtgaggacacagtgacaaggcttgcctttgtaaaacaggaagagggcgcttgccagaactcgaccatgctggcactttgatctcagacttctagcctcctgactgtgagaaataaatgtctgctgtttataccaccccatctaaagcattctgttacagcaacctgtcttagtctattttctgctgctgtaacggaataacagactgggtaatttacaaagaatgtaagtctatttggcccacagttctggaggctgggaagtcctagagcatggggccagcatctggtgggggtcctcctgtggtggaaggtgaaaggcagaaagctgaagtgagtgtgtgagacagagagagaagccagatttcctttataacaacccactctcaccataactaacctctcccatgctaatgacaatccatacatgagtgctccactctcacgacccaatcacctattattaaattcgacctccaacactgactgtggcattgaggattatgtttccaacatatgaacttttgggggactattcaaaccacagcacagcctgaactgattaagacagtgggcttttctatcttctatcattaaaccatccgaaacaccattagtcctctgactgcaggtccagctgtcctgagcagttcaacatttcatatttcgaggaatgcaggttcactcataaacaacacctgtgacagagccaccctcactcacatcctggacactctactgtctgttcacccctgtgcattccaggatgtaacaggcaagatgatcccaactcaggcacagctgcagtgtctacagctgcaggaggtcctgtctccctcctgcccccagcaagaaaacccaagtaaggtatttttttttaaggtatagtttttttccttcaagtttctaattttgacacaatgaaaatattgtatttatattagcaatacccgattagcaatttcatgtaaaggcgattaggtactcataaaaggtctcaagtactccaactaaatcagtcactggttaataacaatgatccacgagctgttttcctggttttcatgtggaataattggcaaggaaaaccatacatgaaaaaagaaaaaagaaaaagatcagcaactttgcagctttagccactatgtgatgtgctatcaaaaagccacctagaatcttttttcatgagttaaaacactactgtcatctataatcctgaacggtaaggtctagaaaccaatactgacagaggtgtccaaacagctcctcttgcagtgctgtggggcacatttcttttaaccttaattgacttcaattactgtgcttcatctcccatggcaaaataattccccaaagaaacaaagagtattagagtgttttcactcatgaaacagcccgtaatgcacctcttttgcttaggaattggaagccaactagatttgagcctgcttgaaagaaaatctcatcactgaagaatccattagtgggccctccaaaatccacacagtcttaaggccagggaccaactggacttcaggaataggatcaaaaaagccaattccagttccatcgtgatgtactgatttaactttgattgtgaaggacagtaatttattgagtaatttatcttgctaaccaccatattaatccagtatccaatcagcacttctctcattcaattccaaggagcaggagtcctagatggttggaagtgtcagacaggaagggaagagtgtcttctagtgtcttgcccagtaattgtacggggctccaaactcctggggagggggaatgatgtctgacttggagcaggccagtggggatggacagagaaaaatttcagcaggtgcccattgctggagtgcaataagtagagcccggggtgatgagaggcctgggggagaagggagagggagggatgacagagaggacaataggaacacagggtcccttgcccttcataatgcccttgattcttgttaaagggaaatgccacggatgtggttggtggagccaacatctctgcctcatccttgatcatcccacacaccccacatccaaattctccctggcgtgttgacccggctaccaacctcacctgcaatcctccctgggctccagctccacctgccctggctgaacctccccctctcacctggactctgaggtggcctcccagtacctcaggtctactcttccctgtcaggacacctgttttagcctaagtcggctcctgtccctcccaggttacagtctgtggcgggaggcccaccagtgataaaatctccgcgccttcccccgtccctggctggcaccctctgcagcctatttctgcctcatttccacggaggctgtctcccattttctctgcagaccagcccccaagtacacatcgtgctaccatagttccacactggtctagctctctccgcttcccagtcccccgcccagggaaggggctcactgaaccagcctgggcacgtgtccactcccaggacagtccactgcaggaatgggcggggcagggtgcacaggagggtgctgtaagctgggcctgctttctaagccaacctgggtgattggggagccaactcaccatggggccgctgcctagcccctctgcttctacgtgactatgatagaagacggcactgaagccttccctctgagaaagttctcagatcttcttttggtcacttctggctcacaccccacaaaagatcccctggacggaagcctcagctctcttatttctggggatgtggctttgagggtttcctcatcgctctgagccttgatctcatctgtgaggggatgactggcttagactttaaactcaagtaggtgaaccccggggcacttggtaaagggaagccctcctgggaggattccgccagggtgtgcagagccacccgtgatagcaagtgatctcattactggaaggttctgaatcggggggagatggtcaccagcacctcggagggttggggcaccattcatcttctgattggttatcatatttggtttgatttcagtcaccccagaggaccaaaatgactaaaataagtaagttattcatctataaacattatgaagcattttcaggcatttaacagatgtaataattacctatatctaagtcatatttgaagggtaactaaattttaattgctttataatatgtcttataatctttttattagcaattatataagcaattgattgtaactatctgtaagtgaaaactaatatctggatagccaaaaaaaaaaaaaaagccaaaaaatcccactctttcatttagatgactggggaatattgaagagtcggggaaatagcaggctctattttaagcatcattttaaaggaaatataacacaatcttaatcgtaggtggaaaaaactccaaagagtacttgttatgattgcaaattcctaagtaaaagccatctacagatgtgacttgtttccaggtattactcttgattttggggacatgtctcttcccttgatgggagaccccctgggtcactgcatcccttgtacatcaaggtttctttcatggcagatgtcatgtcatttttttctccatgtatcagaacgacaactcattccttgcatgacaatggagtggaaatgcagggagacctcaatgacattttattcagctgacaaggaagagacaaactgccttgtcccaggagtctgtgaaaactagaaacacggccaggcacggtggctcacgcctgtaatcccagcactttgggaggccgaggcgggcagatcatgagatcaggagattgagaccatcctggctaacacggtgaaacctcgtctctactaaaaatacaaaaaaattagccgggcatggtggcgggcgcctgtattcccagctacttgggaggctgaggcaggagaatggcctgaacctgggaggcggggtcttgcagtgagctgagatcgcgccactgcgctctagcctgggcgacagagtgagactccaactaaacaaaacaaaacaaaacaacaaaaaaaaaaaagaaaactagaaacacctcatactgggaactataaagctttgccactgccactgctttgtaaaacaagaacttttccctgcctaaggtatctatttcataggtagaattcataacacactaaaacctttgacttggcctgcttggtatagaaaacttatgcatcacaaaatattctgctcagagtataagcacataggtaatgcatgaatttgtggtttatcaattttcaaagaaccttttacaaagacactgaatatatatgagagtaaacatgttgtgatttttggtagttcagacagtaatcagtttctcgctgggcctcagcttgttctgagcattcaggtccacagtcctgaagctaagctagtgtcccgggtagcagcctggtgtatgtatcactgcatatggcggtgagagccagggctccaaagccagactgccggcctgggattctggctccacctttacaatctgcatgaccttggggagttactaaatttcactgtgcctcagtatcctcacctgtaaaatgagaataaatgatacgtgtacctcaccgggttcttgtaagggtaagattagtttcacaaatgtgctgccggtaacgcttagcacacagcaaggctcaatcaacattagctatgactatcatacacgattaatcatctgagtgtctgatcggattgaaaacacaggctcctgcagacaaattcagcagaggactttcaggcctcatgcatgaatgcttaaggaaaagagccctaaagattatgagacgcccatccaagaacatccaagaatgcgttttgcagtctgaactgattctccagggtgctccttgtgttcaactgatgggacaggaacgctgatgtttgtccatctctctttttcttcctttttgagacggagtctcactctgtcacccaggctggagtgcagtggcacgatctcggctcacagcaacctccacctcccaggttcaagtgattctcctgcctcagcctgctgagtagctgagattacaggtgcccgccaccatgcccggctaatttcttttgtatttttagtagagacggggtttcaccatgttggtcaggctggtctcgaacccctgacctcgtgatccacccgccttggcctcccaaagtgctgggataacaggcgtgagccactgtacccagactgtccatctttcattgctctactttctgggtcttgatcgtcctctctcatgactacttcttttactcccatcaaggtaaagtgtgagtgaaagtagtttgattaaagcccaggcagattaaggacgaagctaaaaagaatgaagagacactggtaggaaatactggctgacatgcagaagtaatttcaacgatcttattagcctttcgcctcttgagtacttggttaatgttcataaccagaagtaatgtctctaatctgcatttaactgatattctaactcttccttaaagatacagacctcttttcctcaggcttcataggctagacaattctccttaaatgtcctgagagccgtggcacataggggatgagtggtgggggggcacattcatttgcctggagtgtgggaggagcccccacctttcctgattaatgcagctggtagttctcagtgtgtgcagctgggtgggcctccagaacagtcagtttgggggccatgaggggcaggctctcctggatggtgacaataattttaagagaggggaggtcagtagttggaagtgggaagaggccagaggagagaagagggtggaagagcagagaagcatccctcctcagctcaccagacaaaggataaaatggaggaagtcacaggaccctttgccagagaagcccccaggaagtgtggcacatgcagggcaggagccacgggccccacttcatgctgaggtccttgccaagcccatggcccgcagaccctgttggacggggcagcaccgtgcacctgaaggctgaggccgggccccaggaggggttagatctctttccctccttccctccaggtcgccaggctttgctaatttcatcttccaaatatttaccaagttaatgcccttctcctcctactctgatgtgcctctgcagttttggtcccattatctctgcccaggttggtgtctgtgccctctctgggcctggctctcagtcctgtcccctgctgctgctggatgatctatttctgtaatgcatctggccactgccctctcttccctgctaccccaaacaccccaattcagtgtctccacgttgcctgcagctctgatactgcagggcccaggactttcaagaggtagagccaagggtgggagaaggaagagttggagggacgcccagctctccacctgggagctgagcagctaggggtggtggtgataacatcgacaaggttggaaagagaagcagaagctgagccaatggattccctctgggagcggctgggggaggatggcagggagtgatccgaggggtcccgctctcgtgtatgggactctgtcatgtgagtacacatgtgatggctggcaaaaaagcaactgtatggcaggatcctcatccacgggaaggacagggcttctattttaaaatacactgaacagcaagactgcacatgctttctggaatagaacataaatgcatctatgaatcaaagtcagaaaatatattggtggttgttttcttgctttattttgcgctctcacaggtgtgactatcagttttcaggaatatattctttgctcaatatgtatcttcttcctgccctccttgcttcctttccttcctccagtgcacacagatcgagcccacaacgcagcaagcacagagatgaaaagaggaagatagacgcggggtctgcacccacgaaactcagtctagagggacacaggggtgccctggccagcatctggactcgtgaggctgatgcatcaagccacggcagagctgcctgggaaaggtgcatagggagcactctcaggggccagaggaagggacatccaggcggcaccgggcagtgaggcaagtcaagggtggcggaggttggtggggacagtgttactgggagagggaaggctgagtgcagaggtggagggtagggatgggcaggggcagaaagcactgtgaagggagcttagtggaagagggtgggcgaggggaggcagggcgggagggatacagggagaagggtggatgtgctgcagggacacccgggtggtgacaaaattaaagtgcctaaaaatactcaaggagaaatgaactttgttaacacagtttctttaagaatgtaacgtgcctgtaatcccaacacttagggaggttgaggcaggaggatcacttgagtccaggagttggggaccagcctgggcaacatagtcatgcctgtttctacaaatataaaaataaaattagctgcatatggtggtacgtgtctatggtcccagctactccagagactgaggcaggaggatggctggagcctgggaggtcaaggctgccgtgagctgtgattgtaccaccgcactccagcctgggcaacagagcaagaacctgtcttaaaaaaaaaaaaaaaaagaaagaaagaaagaaaaggaaaaagaaccggttaccatctcaatgaattagagaagacagaactaaagaatatttatatcctgcccaagtgttcacaatgcatctctccgttttcacaatgcacctttcttaccttctctctgttttttgttttttgtctggactaattgctagtcagactgttctcctctctgcagtcccctgaattctgcttgtccctggggcctgggcgagcgctagaaaggagaatgggccagtaatcagctcgtcccacagtgagacacatatcctggtcatcttcctttgctcacccaacttccccttaagtttctgctaagatttgctgacctccctgccctataaaagaaaagcccttttctgattgattttgagatgtttacagttcttgagttccaaggattctcccctgttagttgcaagagtctttttgaataaatcttctccttatctaagacaagattagttttgcttgacaatgcaaatgaccagagggacacagagaactaagaacattttttaaaagggaaaggtcttgttgaaattaaatctatacttaatcagtatcagatcatcttgtatttgagacttcctatcttgtgtcttgagaagggcaagaagcagtctggtgatactgagctataaactagaaaggttttgctatcatctttgcagaactgaactatttatgtggcctacaggcaggttttctgcaggatgttgtatttgttatatgtttatgggaaccattcttctctcgaaataacaggctaaatttgccattaggacattgaatttacccacaaactttgtaataaatactcttcaggctaggatggtaatggctttactttggtctaaccagtctctaagtaaatagtatgaatattcttgctggtttggaactgctctccgctcaatttcattttcctcctggacagtgcaagaacactaaatgtggtgagtataggagccatgtgcaaatgcacaatgcaaattcctttttttctgcaagagaagaggatgaatatgatagatatttaggaagacttagtgaataatggcacttgggagcaaaggagaggaaagagccattccatggtctgagcaatgggaagccattctctgagtgggatggctgaaggggcatggaattgccaggagctaaagggatactgaggatgagcttagtttgagtcatcggagtctgcgtggtgttccacagtaactgcgtggatcagggccggagtcgtcttttttttttttttttgagacggagtctcgctctgttgcccaggctggagtgcagtggtgcgatctcagctcactgcaagctccgcctcccgggttcacgccattctcctgcctcagcctcccgagtagctgggactacaggcgcccgccatcacgcccggctaatttttttttttgtatttttagtacagacggggtttcaccgtgttagccaggatggtctcgatctcctgatctcgtgagctgcccacctcggcctcccaaagcgctgcgattacaggcgtgagccaccgcgcccagccagggctggagtcttaaacttgggagtggccagtgcagagatgggactgatgctatggaagcagatgaatttgcccaaggatggtgtgctcaatacagagagaagggagtttggataaggacccagaatcaggagcaggaagaagagtctacagagacgatcatgatgagaatgaccagagagaaagacggaaaccaagaacaggaggacacatggacaaacccaccataggagtggaggaacacatttgtctcaatgtgtccagcagacaactagttagtaaggacatagaagagctgaacgtgccagatctaatggacatgtaccatatatacatttacctgtcctcaaaaagatatgtatgacttactacaaaaattcaccacaaagtcgtgcacaaagcaaaatctcaactaacaccaaagacttgttattagacacattgtaatcaggttacctgactacagtacaattaaatttgctataaataataaaaagtaggccaggcgcactggctcacgcctgtaatcccagcactttgggagtcgaggcaggcggatcacctgaggtcaggagttcaagaccagcctgaccaacatggtgaaaccctgtctctactaaaatacaaaaattagctgggtgtggtggcacacggctgtgatcccagctactcgggaggctgaggtaggagaatcgcttgaacccaggagacggaggttgcagtgagccgagatcacgccactgcattccagcctgggtgacagagcaagactccgtctcaaaaataaataaataaacaaaataaaataaaataaaaataaaaaagtaacggaaaaaccctccatatatctgcaaaatttaaaaaatactgctaaataacccagggactgaaaaataaatcataaggaaaattaaagaagtctcagaactgaataaaaaagttactagacatcaaaacttagcgtatgcagtttgcctgcttatatgaggaagaaagactgaatttagtaacagcatacatcgagagaagtgagaaaaagaaaaaggaatttggaaggaaggaaaaaatggagaagagagcagaaactaatgaaataagaaacaaagcaatgacaagatcaataaatattaagctggttctttgaaaaaaaactgacaaaaataggcaagtctctggcagaggctgattaacaaagaaagaaaaggaataaattaaaatattaaaaattaaaaaagacataactaggcatagcatatacatgaatttgaaaacctaaacaaaatggacaatttattccagaaaagcaaaacattctaacatagtctcaagaagaaggaggaaatccaagtaacctataatccactgaatcagtacttaactatctactgactgcaaaagaaattaccaagccctggtgattttgtaacttttaccaaacattcaattcaagaaataggtaagtttaatcttctgcaaactttgttttcagagggaaaaagaggggaacacctcccagctcatctttctaggctagtgtaaactaaaaaataaaataaaattaggcaattgcagtatgaacaagggaaagcttgattcatataatttatgaataatgatgaaaaatctttaataaaagaaaagcaaagtagattttcataattatatgaaaatattgtgcctaagttttatcccagaaatgcaagaacggttccacattagaaatccattctacatgaatatatattcatgtagtttcatgtatattcactatattaacagaatacagttatatgtgtatgaatgtgtatatacatatatacacacacatatacacatacaaatacacacatgcatatatacttatctcaatagatgcagcatttgctaaaatttaaaactcatggcaaactcttagcagactggtaacaaaatgggattcccttcatctggcaaataatatttagtattagaaattttcagcaaacattattcttaattattaaactctttcctttaaaatcgggaacaagacaaggatggctactggctcaacttccattccattgtgttgaaagtcctaaccagtgcaggaagatgggaaaaattaagaatcaatgtgaagactggaaaagaagaaacaaaactgtcgttattcccagatgatggaaccctctaaataaaaagtcctaaacaatctacaggcaaactgttagagaataaaaaatttaaagtaaaaaaaagaatttttttttttttttgagatggagtctcactttttcacccaggccagactgcagtggcgctatctcagctcactgcaagctccgcctcctgggttcatgccattctcctgcctcagcctcccaagtatctgggactacaggcgcccgccaccgcacccggctaattttttgtatttttagtagagacgggggtttcaccgtgttagccaggatggtctcgatctcctgacctcgtgatccgcctgcctcggcctccgaaagtgctgggattacaggcatggccactgcgcccggccaaactaaaaaaattttaaactccctacttttccaataaggacaaaatgatatgacacctaggaatatatatttaacgtaagttgatcgagactgtatattaaaaatggtaacatttttattgaaaaacagaaggctaaatgaaaagctgtaccaaaaatgataattctccccagattaacctaaaaatacaatacagttacaatgatggtgtgtgtgtatatatgagaaagaaagagagagagagagagaagggagagagaagagagctctctctccatctctcttggaggaatgagaatggccaagacagttctaaagaggggaagagtggggatttaccctattaactacaagacaaatacagaaccagtatttcccgtaatgtggtaacaagagagacaagccatagaccaataaaaaaaaagagccctcagaaatagacatcttcaaatatagaaacagattggtgctgtaataattgatgactatccatacacaaaaataaatacaactagatccgtatctcacaacacacaaaattaaaccccagggggattactgagctcagtgtgagaggcaaagttttaaaacttccatgaaaatacagaaaatttttatcacttggggatggaaaaatagttcttaaaatgcaacactaaaaggacacatcatccaggaaatgaatttgcctgcattaaaactgaaaacttctctatcacaaatgatgcccaaaacaactttgagtgatgagtcactgatcgtgagaagacttttatgacaaagggaaatcgtttagagtaaagagcaaataactcagcaggaaaagagaaaaaaccagggagttagcagatcaaaacaaatagccatcagtcacacagaaagcctgaggacatcgagaagcaaggctgccttttccactggccaggagagcggggatccctgccatcgctgtggagtgcggtgactaaagtcctgcagatgcacttcccctgtgagccagcaagtctgcaggctggagaaaatgcagcaggtgcacacacgctgccgagtgcacatcactccgcattctagcactgttagaataatgagaaactgggaacaacccagtgtccatgaacaggagatggagaagcaacctgtggaatactcgctcaatgcaagaccatgcagaagccccacgaagatgactaaggcaacccttatctacatggatcagtatcacaaacctgatgggggtgagaatagaaactggcttacggtaccaaatgcgtcaactttgatgtaaagtttcagtgaagcagacaactctgcaggggaatgaaaaattccctgatgcctcaggatagtggctgcttctggacaatctctaatttcagacagagggagggacagagagccgtggcagtggaggggactcagatgggtctgcaacaatgtatgataatatatttcttatttaaagaaaaagaatagaagcaaatattgtaaacatagtaagattgaataaatctggaaggtattatattattctcatacttttctgcacgttgaactagctagtaacttttttttttgagacagagtcttgttctgttgcccaggctggagtgcagtggcatcatcttggcttactgcatgcagcctcaacctctcaggctcaagtgattctcctgcctcagcctcctgagtagctggaactacagccacgcaccaccacatccagctaatttttgtatttttagtagacacggggttttgccatattggccaggctcgtctgaaactcctgagctcaagcgatccgccggcctcggcctcccaaagtgctgggattacaggtgtgggccactgcacccagccactgacaacttttttaagggtgcagtgctcaactttcagatgtgccaggagatgcacagaacaaggacctgctgagggcaccgctggtcatttgcacggaaatgacccattggctgtcccctgctctgctgcgattcttcaggcaccacctagtctccgtctcctactaagcggatcaggttggaagtggaggaagcaatggatctggcattaaagatggaaatctggatctaccaccagttgagtctgcagctcagcccctgcacatcctggggcctccattttcccatctcctcatggaaatcatgaagtccgcctcatggacttcactgcggttggggtggtggtggagaagacagctcatgggatttgaaagggctgcataaaccagttcccaaaggatgcctatgcagcgaaaccagcccgggaccagcgcaaaataatactagtaggttttatgtctcccatggatgctctgctcctttgtccagtgccctgtcctgtggcccctctcactttggggaccatgggacatggagcctacctggagatcagaggttatttttaaagcatttggttatttcagggctctaaatgagtatcagaatgagagagaggagaaggcagtattgaacggtatgagaccatgggtgtggtggtgtgtggccgtagttccagctactcaggaggctgaggcaggagaatcacttgagcctgagaggttgaggctgcatgcagtaagccaagatgatgccactgcactccagcctgggcaacagaacaagactctgtctcaaaaaaaaaaaaaaagttattagctagttcaacatacagaaaatatgagaataatataataccttccaggatattgtcccagcatgttggccaggctggtcttgaactcccgacctcagaatatcaaattgctcagaacaattgtgctccactcccctgtgattataggattccctgctcagcttcctggaaccagtgcctatcggtttcggaatcacacccaatgccctccatgcatctctgaattcatgcattattccagtcctatctttcctgcctttgcttttgtcctttgttcttcccctgctcacttacctgtcatgaaaacttccaacagcttcactgaggtaaaactggcacacaacgaagggcacccatttgaagcatgagtctgatgagttttcacacagtacacattctgtgctttcatttgccctgctgccatttttaggtattcttttccacggccccttcttcccatggtccctttttatttatttagagacagagtttcgctctgttccccaggctggagtgcagtggtgtgatttcagctcactgcaacctctgcctcccaggttcaagcgattctcctgcctcagcctcctgagtagctgggattacaggcgcccgccaccacacctggctaatttttgtatttttagtagagacagggttttgccgtgttggccaggctggtctcgaactcctgacctcaggtgatctgcccacctcggcctcccaaaatgcagggattacaggtgtgagccaccacggtctctttattctagaacatctcatatggttcaatattgccttctcctctctctcattctgatactcatttagagccctgaagttaccaaatgctttaaaaataacctctgatctccaggtaggctccatgctgtcctctcccgtttgtttactcatccatctgcagcactttctccagtctggtgtttggcccccgaatggggcggtggagctcctcccgtactttctgtttggacactagagtgactggggtactttagagtgtgaaaatgggtctactaatatctatgctggaccatcttcgaccatgtggtgtgtgctaaccctaaacagaaccctctcctgagatcctgacacccagcctgtgctggcatggcagagaccacacagctggaaggaaggagggactgtctctctgtagttccttttatctgaatgtgctccgaactgtgggtccctgcattgggggaaggagggagtctgtatggcatagccatctgggtcccagagtctcccaagaagctgccctaaatcctgccacatcacagctgccaaaaaactccaaaggcagcacctcccttagtggtggctccagaatttcaactctgggactgcaatctggaaggaggctgtgtgtgcaggggaaggagtggtatcttaaagctgtgtttgcacagcacattgcattagaccttaaaaatgtccaccatccatttcaaacagtgggagcactacttataaaaattataaaggcctttagaacccaccctccccataaattaccaccggcaccataggtgattccacatctgacccatcaaacacctatcagtccttgttcttcaaaatgagggcatatttgagacctagtatggcttccagtaacctcccagaaggcctcataaagctgagttgaaagttgttctttctctttctttgttctggtcttatatgcaatatgtctggcagaaaattctagaacattctagaaaaatgcaagtgatgcattggccattaaggaagggtacaggtcttcagccatttttgtgtaggttttctgtcatttcagctaggattagaggtgaggtatgtgtatacatggccaaccatctgtgttcccattaccacatacctagagctgtgtttggtatcattcagcaatagaatcccagatttttttcatatattcccacttcctcagcttcttagatgctaccgttcttttcctatagctaacctacccgtatatcacccatacacactgaaaactgcatccgtcatcctactcaacaaaataatggctctctttcaggacagagggaaggattgaaaaaatttctaagttaatattttaatttcctgtcatagtgaaaacacaacatattacactgtcactgtctgtttttctttctttcttttcttctttttttttctttttgggacagagtctcactctgtcatccaggctggagtgcagtggtgcgatctctgctcacttcagcctcctcctccagagttcaagcaattctcctgcctcagcctcccgagtagctgggattacaggcgtgtgccaccacgccaggctaatttttgtatttttagtagagatgaagtttcatcattttggccaggctggtctcgaactcttgacctcaggtgatccacccgcttcagcctcccaaagtgctgggattacagatggaaaccactgctcctggccaactgtctgtttttcttgtctgtttcccccagtagacttggagggcagagtcagtgtctcttatctctgtacatccagtggccaacccagacacagaagaggtgctcaaaaattttctctgaatgaataaattaaaaactcttattgatttcaaaaacagttactgggtataatttgtgccacgcccctcgctgtaagccagaaaaagacaggagaaatgccgggcagtgaggaggccaggtcaggctggtgaccacagacatataagctgctcacccacaggctgtgcggtatgctccactggtcttgttgctcaggatgcaaacaaagagatagcagatatttgggctcatccagggatgcctgctagccagggaggcaccacagaaaagcagtatgagaaggagctctcacatactggtccagggatggctgaacaggtggacatggctcatgcatagagagaggggcggtatcgcacagtggagtctggctgaagctggacagcactcaccatggggctgtgtgaaatattaataataagatatgtattatgtgtctttggtctctgctcctcagtccctgctaaagagctgctaaaatccttgtcacttcctgagtgacaggggcactaggtaatctttttgttgttgtttatagttagtttttctttctttttttaattatactttaagttttgggatacatgtgcagaacatgcaggtttgttacatgtgtatacatgtgccatggtggtttgctgcacccatcaacacatcatctaggttttaagccctgcatgcattaggtatttgtcctaatgctctccctccccttgcccccaccccctgacaggtcctggtgtgtgatgttcccctctgtgtccatgtgttctcactgttcaactcccacttatgagtaagaacatatggtgttgggttttctgttcctgtgttagttttctgagaatgatggtttccagcttcatccatgtccctgcaaaggacatgaactcattctttttttatggctgcatagtagagaatcttctgttttagtatttggtgtttgaccccagctcctaaatcctttggaatttcctgggtgataggagtgtcttttgttctaatgaagcgactcttgatggaattctagatgggtgctgggtcaccagaatgaccaagccatgatgacgagcttggggctttcagccccactccccattctccagagaagggacagaggctggaaacggagttaaaaatcgatcctgcctacatgatgcagcttaaataaaagtccctgaacggaggggttcagagagcttctgcgtcagcgaacacatccccatgccaggagggtggcgtaccctcgctcctcggggacaggggctcttgtgctcaggactcccccaacctcgccacatgcatctctccacctggctgtgcacctgcatcctgcctcatatcctttataatcaacaagggcatggaagtaaagcctttccgtgggttctgtgagccactctagcaattcaatcaaacccaagtagggggttgtggaagccccagtttataccccattggccagaagtacaggtcacaacctggggcttgtgactggcatgagaagtgagtgtggtcttgtggggctgagcccttaacatgtgggatccaacgctgtctccaggtaaagagtgtcagaattgagttgaactgagcacacccagctggtgtctgctggagaatggtttggtgtatgggggaaatgaatacatctggtgtcagaagtctcgtgctgagtggtgtgtgagagtagagcactggaggctggaaattgtcttgctttttttttttttttaactttcttagagacaaagataagaaagcacataaactcaataactgattgatttcttgggaaacttttatctccttgtccattgataaggtttctctgggtaatttggtttattgtggctcagtaaattaaaccaggtacatgaaagaagaataagatctttaactttgatttgaattaggtcactataataaaagcataaggacattgttgaatacagcaaagcactaaaggtggctagatgcagtgtcaacatgttacgaagcatatttcaccagttaacagttctgatttttgtaacttaaaaaaaaatactgtgaatactggtccaaaaatatgtcacagtcttgcgctgggtttgacttggcaaaaatggccatcaatctacctaaacatctttttattgtttaagcatttattatgtcattttttgttacaaaagccgagacactgtttcatcaggaacgggggtctgtagccttgctttttcagtagcacttgtccatcactgtcaaaggctttgagaaggcagatactgaaatcctaatttttagaccctatttcctgactattcataatgagatgcccagaggcaggccctgtcatcgggaagcagggacatgggtcctggagggctgagacactcagatggtccctgccctccaccaggacctgctcaggaacccaggaggagccacctgccctctctctgggctgcagccttcacacctgcaccatcggtcaatggaccccaggatgcaccctccctctggctctacaattctgtgaatccctgtgtggtgtggtggagttccaggtcccctctgtgccctctgccctgctcctcgctcagccccataaggaggtaagaaaccatcaatatcctcaagagagaggcttgttggcccccaggggttctctgctaaaaaaaaaaaacagagaatctaggagcagggccagtcaggaagggcagaacagagatccaggggtttcggggcctccaaaccaacaaaagacaatccgagggatgagtgaagcaacatctgcatgctcttctggattccaaatttattcctcctcggccatgaagaaagttggtttctgcttttttccctgaggatgggctgtgcctgtacagccttccaggtatgggaggggaggaaggaggggagggtgcctgacaggaagcaagtagttggacaaatctcattaagtcagtatcagttaattcaaacacaactaaaatcaaagtgctttgattcccaagccaattatataggatttcccccacataaattgagttcattacatagtaagtatagataatccataatttaatatggaaaattcagacatggagtgttactaatcagataaacagagcctcaaattagactatggaaaagatcaatggacctgctctaattgccaaccaaaaagaagcaagcaaaagggaaattaatcaaaggaacattctcctttgctccttctttagctaagcgtcaagaacattttgcaggtgataggaaggggctgtcctggatatccgtgcaaaagagtagagcagcctcttcccagagtggctccatttccaatggcccatatttgttctgctgcccaagagttttaataaagcaacaccggatccctgcagaagatcctttcactgcagtcaaagtcatcaggcacagcttggcttggatgacttttcaagagtaaggattatattaaaaatgactgcaccactaattatgagaaaactagataatgtggcacatgactctcagaggaagaagtatctataattatgggaaggaagtacaaaatcttaattatgctaactatttaaatagagcataaggcttgagatagaatttaagggttaggaatctgccttagtgctttgaagtatccatatacttcagaaaagggatctgaaaaagatataaaatacactgaaaactccactgtaattaactagctagagacatccatgggtgcaaaccgtaaccaaggagagaaggctgctgcaatctcagggataaaaacgaagacacaagggctcatggaaaaaaaagacaaagacagaaggagccgaggagggagttgccaagactcaagatcacatcgcaagcagaggaaaaaggtaatgcctgctgcagaaaacagccaggaagagaagctttacaaaaaccgaacagggataggggcagtggctcatgcccataatcccagcactttgggaggtcaaggcagcaggatcacttgagcccaggagttcgagaccagcctgggccagtgagatcctatctctacaaacaataaaaaattagctgggcatggtggcatatgcctacagtcccagctacttgggaggctaaggtgggaggatctcttgggcccgggagtttgaggctgcagtgagccgtgatcacgccactgcactcaacctgggcaacagagtgagaccctgtctcaaaagagtttgttaagtcattcatgctacatttccaatgtgggtagggtgcaggacgctctgttcattgtagtgacccaggctgatggcactgccatcacctctactctgccaattactgtgccagtgggaaagagagctctggaagacctcaaaccacatttaaacattctgacttgaaagtggtacatataagctttgcttacatggcccccagcaatcatgaggggacagggaagtacaatcttaccatgtaaaaggaagttggagagctagacatgttttaaaacagcattaatgaccatcacatacctaaaggggagaaagcatttggctgactttcagatttttccctatacagatattcaatgcaaaagagaataacatatcatctataaacccctaagagaaagtttcctcaagaattctgcacccagggggaaaaatgatgtagaacattattccagaacattattccagattctgctgaggatggagaaagctggaaagaacattgccccaccattacaacaacaagaagaagacattgggttctgcaaattcccaacttaaggtgaacccatcagacagctgaggtcacaggacagcaaattctaaggaaaagacagagtctccaaggagagacatgagcacttacctggggcgtatgcagtcagataccagctctagtggaaaaggtggacaagatggaagatcactgaggtaaggtagcagagaggtggaagcaatgaggaagagtcaaatgcaaatactaggaattaaaaacaggcacagagatgaagaatgcctttgatagacagggtcggcagtggactggacacagttgaggaaaaaatgaccaagtggggtttatcttgggaatgcaaggctggcttaccactcaaaagtcagtgttattcaccatttgagtggactgaagaagataatgtatagcaacatctaagcagacgtagtaaaagactgataaaattcaacagccattcgtggtattaaaaacaaaacaaaaaccactctcagcaaactaggaataggagggtacttctacaacctgataataaacatctatgaaaaacttagcgctaacattatacttaatccctaaaagcaggaacaagagaaggacatctgttctcaccatatctattcaacactctacggggcggtctagtcagtgtaataaaacagggaaaagaagtaaggggcatccagattgcaatgtgtgctgatttattttaggtgtcaacttgactggatgaaggatactcgagaactggcaaagcattgtttctgggtgtgtctgtgagggtgtttccagaggagattggtgtgtgagtctgtgaactgagtggggaagatccaccctcaatgttggggggcaacatctgatcgtctggggacctggatagaacaaaaaggcagaggaaaagcgaattattttcttttgctcttctggagctgagacaccctttcctgcccttggacatcagaacttcaggctctctggcctttggaccctgggactcacactggtgcaaccactccccgcaggttcttggccttggactgagagttccaccattggtttccctggttctgaggccttttgacttcgactgagccaaactcccagctttccagggtctccagcttgcagatgggactgtcataggacttcttagtctccatggtaatgtgagcaattctttcaataaattccctctcacctatctgtatctgtcctattggctctgtctggagaatggaagacgtaaaattgcctctctttgcatagcacatgactgtctacataagaaaacccaaagaatctgcaaaagagctaccagaactgagtttagtcaagaccacaggatacaagattggtaacaaaaatcaaatttctatgtgctagcagtgaataagagaccattaaaaaataccattaggatagcaccaataaatgtggaatactttaagcataactattacaaaatatgttaagatctatatactgaaatttacacaagactgatgaaaaaaagaaacactgaagaaatgaagtatgacttaaataaatgaagaactagatcatgaatatgtcaagtctcttcaaagtgacatgtggactccatgcaatctcaattaaaatcccagcaggattctagtagaaaatgcacaagtggattctaaaatttatatggaattacaaaggaaatgatagctaagacaattctgaaaagcaacaaaattggacgacagcaataaacagatactcgcttccaatagtccctggtcctcttgatctcagatgaaagtcagtccctgccaaggctgttgctccttgcataggccctcaggtgggggacaggggcaggctgcctcttctcctagcacctaagccactgctgccacttccagaccattggcctcacaccttaatcacaactcctgcctcctttgagcctcctgccaccagttttgatagttcctatctctaagtaggctttgtacacaaattcatgagggagtttaaaatagtgtagtctttcctttgctttcaactcttaccagtgtcctgggcaatctgaatacccatggggatgtgccatgcattcagctaggctcccagccttccctggaacttcttgacttcagtggcctttactctatgccgtttttgccacctcataccaagggcttttctcaccaatgtaccagaacagtgaataagagtgagactgcaaggtcaccagctccccctagacctgagactgcattcttagagacagtgttgttttttcaccagcattacctttcaagccacagtcactgctgcaggggctggagagtcatgaaaaccgggtcctgcatcccatgagtgaaggcgttcaagggggacgccaggaccttagaggagcctgttgaacaccccaaccagccaactgaggaacgggaggtaacgtgaggcccaaatgcatccccatactcaagaaaacattcccaggttgaagaagtgacttagcagttgtcagaatgagatcgcagagtgagcaacggctgcccgtgtcccctcccaggagggctgtgaaaggccacagcagacctcaggcactgacccaggcaggctccaggatgcagtgaggtagaatgtgggcgtaggtaatgtgggcagcatgaaatacctggtcccatgatgggatgggccctggagtgctgcagttcttgattcctccaaccccgctgcatctgtcactctggtgagctgctgggaccatccaacttggaccattcctccgtgcaaaacatgacaggcgctgtgagccaggcgtagtcctaccatggagatgagccgcatcctctctctctgtacatctttgcttgtctaccagccggagaccacccatggaggactaatcacaagcactcaaggtcaacgctttcctcctctccccagatccgaggtggctctctgcagtttcccatcccctgcatactgcattccctacacacatgctagaaccccctccatactgcaaacacaattttaccaccaactaagagttccttggactgtgccacatctttttatatttatttatccatttttttcttttgagatgaagccttgctctgtcaccaggctggagtgcagtggcacaatctcggctcactgcaacctctgtctcccaggttccaatgattctcctgcctcagcctcccaagtagctgggactacaggcgcccaccaccacacctggctaatttttgtatttttagtagagagggggtttcaccatgttggccagactggtctcgaactcctgacctcaagtggtccggctgcctcagcctcccaaagtgctgggattacaggcgtgagccactgcgcccggcttgtgccacatctttttaaaaagttttggcacagttttattcaggggaaacagaagaattgggttcactcttcttatgtatttttaagtagccaattttgcttttcagaataaaacactcggaagaaaaaataaaataatataaacaatttttccaaatcactttttttttaaacatcaaatgctacacataagaatagactcccaggggagactgtctgatttttttcctccaaatatcttttaaaaagcaaaataaatccccatttgttccctgatggtataacagccaaaaatgtcagaaaagccgtagaatgatcccatcatcatttgtaaagacctctttcaaccatttgcatccgaatttgcagatgtcagaggtaggacaatgaaatggcaaaaatgcaaagtgagatccagaaagcaacactttcaaaatcaaaatatataatcctttcaaatgttctctggaaagatattccctcttgcactgaacctaccccgggaagttaagagctgaaaggaatctatatgttaataaggcttcctaaactgtctgtaaggcatggaatgaaatgcatgcacaagcagcgcccagcggggtcaccttcaaggtcagcctcacagcgttgcagttctcctgcagcgggttcagcttcagcgtctccccgaggttgctgcagccggacgactggtgctgcagctcacagcagacacacacctccacactgtcaaacttaatctagacagaggaacacagacagacctcaccgttaacaggcattcgacccccgagggtacgcgtgagtgacacagttcagaacacaggaaaatggctcagttcaaaggagcctgtttcagtgtgtttaagtagtacagcaaaaacaatttctattgacccaggccatcaggaggacttcaaattcctatcttaacagcaatgtatagaaaaagcaaaagtacatttgaagaaacttaagctatacattagagaaaatggcaggtggattacaaaatgagataaaggtaaatagattgaaagtcactcatgctgatgtatgcacggagatgtgctatcctagctctgtgccttggctcattctccttccacagtcagaaatttcctgcctcacttcatggcctatcaaactcctgctcatccatcaagacccaactccagcgccaccctcgaggccttgtctggttttcctgcctcactgctactgaagactgactttatccagctacaggtgcatcttatcaccacagtattgacaatggcaacaagttgtaggtgttcaataaatgctgaatgaataaaaacggcttggaaaatggaaaaccatggaagaaaaaaatgcatttcaagtattttaaaaagcagtgttagacgaagagagagtatgagagtctcagtgagagggaagagaacagagttaccagtgcctaggagaaaagcagctttaaaaaagtaaagtcctagccaggtgtggtggtacaccacctgcatttgcagctactcggcaggccagggcaggaggattgcttgagcctaggagtttgagaccagcctggctgggtaacatactgagactctgtctcaaaaatacgtaaataaaaaataataaagtcctagatgtaaaactactaaaaaagaaaatcaggccaggcgcggtggctcacacctgtaatcccagcactttgggaggctgaggcgggcagatcacaaggttaggagttcaagaccagtctgaccaacacagtgaaaccccgtctctactaaaaatacaaaaattagctcggcgtggtgctatgcacctgtaatcccagctactcaagaggctgaggcaggagaatcgcttgaacccaggatgcggaggttgcagtgagctgagatcatgccattgcactccagcctggatgacagagcaagactccatctcaaaaaaaaaaaaaaatcagtaaaatctatgcaattttattcaaaataacactgaacatgaaacaagttattttccttagactaagaagtgccctgctttccaatagataatatgtttacagcagccaactcgaagtacaaatacttttcagacaaatattggccatttataaccataacaaataatttttcattgcatgaatattgctgagactgaggccatacttataaaacctccaggtatcaacatgtccgcctctcctaaatactgggggaggggtaatggagcatcctcagagccaagaaatgtgctgatattcaccagaggaactcagcttagcttaagacttagcccctgccaccccctgctccatgtcaggtgggctttgcgagtggctttcagcaggagaatatgggtagaggtgtcagcttgcagcttctgaacttaagacctccacaggcttcatgtttctgcaccctctccctggaacttccaatatacagcaggaaaagaacagattccagggagctgccagctctccagtcccagcaggaaacccgtggagcacccctgcagaactgttctgccctatggtacatgcacacacaacattactaggtaagatcaaaccatttttcaaataattcaaacaaattatactcccaccaatagggtgtgaattcaggctaatccacatcctcaccaatgcttgctaatgttggacttagacatttttgtccatgcagtaactaatataatagtatctaatttgggggtgggtgggtttgttttcatctttcctcattttcttaaccgttcatattgtgaaacctaacacacatacacaaaaagtgcacaaagcaaacatattcagttcaatgatttatcattaagcaagcacccaccggcccatggccatgttcctaaaaggccttccatgcctcattccctgtcattcctcccacttgctgcaccaaaagctcaccacattccttactttttaaataatcacttctaggcttccacctttatacatttaccactatagtttagtttcacctggttttctaacttgatacaaatagaatcatacaatatttttagtatttggcatctttcattcaaaattacaagattcatctaccttactgcatataaatatagttgatcatgttcactgttgtatattacattgtgtgaatatgctgccatttatatatctattctcttgtcacgggacgtttggattgttgctaatttttttgcaataagattaatgctgtttgatattctgtactagtctgctggtacatacatgtgcatatttcttttgggtacaaaatacctattgatcagagctgctgggtccctggggattttcagctttagcagagaatacaaagccactttccaaagtggctgtaccaatttacacactcaccagcactgttcgagggtccccattactccacatcctggcttgtgcttgttttagtctttttaattttagataagaaagtactggaagaggtacttcttccttgaaatgagggactaagccaagaaaaaaagggaagatgggatctaacacagaaaagagatagaggaagttctaagagaatgggaaaaggatgtcctagcatggtaaatatatagactgcctataggctgacttgttcagactgaagcaggaaacaggctcaatggaaacgtctctaagaaaatgaagctgacagaacgcttgatgggtaggactgtattcagaggagattttcagttctcctgggaagtttgagagtaaattaggaacagagacactaaacaaataataaaacaattttaactcagcataaaagacaaatcatatatagtacatggttttgttatatatgcggcttgtaaatattttctcagtctatagtttatctttttatcctctcaaaaggatcattcattgagtaaacgttttaaattttgatgaaggccaacttacatatttttgctcctacacttttggtgttgatctaagaactctgcctagccctagatctttctcctatgttttttctaaatgttttataattttatttttacatttgattgcatgacccattttcagtcacttttagtgaaagatatgagacttgggatgaggttgactatttttgcctatagatgtccaattgttccaacatttgttgaaaaatctatcttttctttgcttaattccttttgacttttgtcaaaaattagtcgggcatatttgtgtgtctctatctggattctctctttgttccattgatctatctttccaccaaccaccaagtcttgattactgtggctataagtctggaaatcaaaaaattaattcctcccatttaattcttatttttcaaaattatttgtctctccatatacattttttttttgagacaggtcttgctctgtcacccaggctggagtgcagtggcaccatctcagctcactgcaacctccgcctcccgggttcaagcgattctcatggctcagcctcccagatagttggaattacaggagcacgccaccatgcctagctaatttttgtatttttagtagagacaaggttttgccatgttggccaggctggtctcgaattcctggcctcaagtgatcctctcacctcagacttccaaagtgctgggtgtacaggcgtgagccaccacacctcgtctccatatacattttagaataagactgtcattgtctccaaaaaaagtgttgctgggattttgatagggattgaatcaaacccagtttcttttttttttttgagatggaatttttgctcttgttgcccaggctggtgtgcaattgcgtgatctcacctcactgaaacttctgccttctggattcaagcaattctcctgcctcagcctcctgagtagctgggattacaggtgcccgccaccaggcccagctaattttttttgtatttttagtagagatggggtttcgccatattggccaggctggtcttggactcctgacctcaggtgatctgcctgccttggcctcctgaagtgctgggattgattacaggtgtgagccactgtgcccagcccaaacccacatattaactggggggaaatggacatatttactacattgaattttccaatttatttatttcctcattgttaacgcagttttcagtgtatgttttgttagatttacacttatgtatctttttaagcgatttttaatttcagtgtccatatgctattaatatgcagtattactgttactatacagttcactattaatacacaagaaatacaattgaattttgtatgtttatcttgtatcctacaactttgctgaactcacttattaattctaagaggcttgtttgttctgtttgttttttaaagattctttgggattttctacatagatactcatgtcatccacaaacagagttagttatatttgttcttttctaatctttatgccttttattttattttcttgccatactacattggcttgaaattacagcattatgttctatattgaaaaaaatggtacgaatgagcatgcttgccttgttcctgatcttaggggaaaagcattcagtctccattaagtgtgttagctgtaggtcttttgtagatgctctttttcaagttgaggacgttctctatgcctatttttctaagtttcctttttagttatgaaaaggtgcttgagtttgtcaaatgctttttctccaacaattgatacagccatgcagtttctcttctttagcctgttgatatgatagaataaattgactgatttttgaatatcaaaccagttttgaatccctggaataatccctcttggcaatgatgtatataactcctttcagatatgttgaattttattcgttattattttgttaaggatttttgtatctatattacattaataagggatattggcctgtaattttatttttctatactgtctttgtctggattttggtagcatggcaatattactttcacaaaaatcaatttggaaatgttccttctattttttcagagaaattgtgtagaaatggtattaattctataaatgcttaatagaattctccagtgaaaccatctggacctggagattttgtttttggaagttttagaattataaattcaatttccttaataattatagggctattcaaattctctacttcatagtgtacgagttgtgttagttcgtgttttccaagaaattgatctatttcatctaagttgtgaagttcatttgtgtaaagccattcctattattcccttattatccttttgatgtctgctgggtctgtagttatatcccggtttcttcccagacattgggaatttgtgtcttctaactttttttcttgctagagttttgtcaatgttgttgatgttgtcaaagtatcagctcctttttcattggtttttctccattggttttctgttgtccatttcattgatttctgctctttcatttatgatttcctgacacctatttgctttgggttgattatgctgctctttatctagtttctttttttaattttatttttagttgagaaataattctatattacatatttatggggtacagtgtgatgtcttagtaatgtttacattgcagaatgattgaatcaagctaattcacaaatcacctcccattttaaaaattttttttattttactttaagttctgggatacaggtgcagaatgtacaggtttgttacataggtatatatgtgccatagtggtctgctgcacccgtcaacccatcatctaggttttaagccctgcatgcattaggtatttgtcctaatgttctccctccccttgcccccaacccctgacaggccctggtatgtgatattcccctccctgtgtccatgtgttctcactgttctactcctacttatgagtgagaacatgcagtgtttggttttctgttcctgtgttagttttctgagaaagatggcttccagcttcatctacatccctgcaaaaggcatgaacttattctcttttatggctgcatagtattccatggtgtatatgtgctacattttctttatccagtctatcattgatgggcatttgggttggttccaagtctttgctattgtaaatagtgctgcaataaacatacatgtgcatgtgtctttgtggcagaatgatttataatcctttgggtatacacccagtaatgggattgctgggtcaaatggtatttctggttctagatccttgaggaattgccacactgtcttccacaatggttgaactaatttacactcccacaacagtataaaaccgttcctaggccgggcacggtggctcacgcctataatcccggtactttgggaggccgaggcaggcggatcacgaggacaggagatcgagaccatcctggctaacatggcgaaaccccgtctctactaaaaatacaaaaaattagccaggcgttttggcaggtgcctgcagttccagctactggggaggctgaggcaggagaatggcgtgaacccgggaggcagagcttgcagtgagctgagatcgcgccactgcactccagcctgtgtgacagagcgagactctgtcttgaaaacaacaacaacaacaaaattgttcctgtttctccacagcctcaccagcatctgttgtttcctgcctttttaataattgccattctaactggcatgagatggtatctcattgtggtttttgatttgcatttctctaatgatcagtgatgatgagctttttttcatgtttgttggctgatatatttatctttttgtggtgaaaacatttaaaatctactcttaagcaattttgaaatatacgaggcattatttattttagtcatcattttgtgaaatagatcactaaaacttactccaatctaactgaaattttgtaccctttgatctatatcctctttggcttcaactgtttccctttgctgtgatcaactggacaggagtccagctctcctgaaacagttcactctcccacgtctcaaaaacattcaaggaattatctcatatgatcacatctctaggctaggcattaagattgaagtagctatcataaatggcaagacattttcctcagtctgaaggatcatccggggaaagggaggggagatcagcttgtctggaaagcatgatttatcaaataaaataacccttcaatgaccccagggaatagacatccaaataaatcttttccatcagttatttcactgagtttgtgattaattcttaggaaaattctgaaaacctcctggttagttccctgacctcgacatctgggtgtgcaggcggctgacagatttattttaagagtacccctcagtgttcgggtcattgggaacgacaccgcagagctttgcaaatgaggccacagtaatttttcacaaatctctttggggcacttaacagctagcctgccccccttatttatggtctatcagcctgtctgggagtagaaagggcttatacaacaaaaagagggggatgcccccacgattctcttacagaagtacaaatgggatgggtatgtgaccttcagatattctcaaagggaaggcagtgtgggaaggctgagcatgtaggcagagcagggcagagggctgggaagaggctggcatgtgtcaagcccgagaacttacagtgggcacaccaaggccagtatccttggatgtgaggagcctgtttcgaggaggaaggaggcgcagcacgggtgacagagtcagactactcacagtcctaactgccatggagtgacccaggacaagccatgtgacctctctgggcttcaggttcccggaccccagtgaggatcaaatgagattagacaggtaaaaatgcagagtgccaacgctatttgccggtgttattgatgttgctattatttacattaaagaaaaaatttgtagaaactagaccctaagttttcttcccaaaggttcaaacaaagctacaaaaactagaccctaatttttaaattgtggtaaaatacacacaacataaaatttaccatcttcaccatttgtcggcatacagttcagtggcattaaacatattcacctcgttgtgctaccatcaccaccatccacctccacaactttttcatctttccaaactgaaactctgtcaccactaaacaaatccccattccctctcccacaggcccccaacaactcccattctactttctctctctgtggattcactactccaggtacctcctgcaagtggaatcaggcagtatttgtccttttgtggctggcctatttcactcagcatgtcttcaaggttcatccatgtggtagcacgtgtcgagatttccttcctttttaaggctgaagaatgttctatcagatgcatctaccatattttcttgataattcatctgtagatggacacctgggatgttttcagctcttggctgctgtgaataatgctgctatgaacatgggtgtgcacatatctatttgagtccctgctttcaattatttgggtaaattcccagaaggggaattgctggatcatgtggcaattctctgtttaatgatttaagaaaatgtcataatgttttccacagcagctgtgccattttacgttccaccaagagtgtacaaggcttccaacttctctacatcctcaccaacacttattttctgggttttcaaaaaatcatagtcattgcagtgggtgtcaggtggtatctcactctggtttcgagttgcatttccctaaccattagtgatgttgtgcaccttttcatgtgcttactggccatttgtatatattatttggagaaatatctattcaaatcctttgcctgttttcaaattgggttgtttgtgttcttgttgagctgtaggagttctttatacattccggatagtaacctcttatcaactatacaattggtaaatattttcacccacggagcctcttctgttgattgtgttctgtgatgaacagaagtcaattcaactttttgaatacttgtaggtttccatcactttcacaaaaactgtcagtaacctgttgatttctccctaacccagtaatttttgcttcctttgtctcaagaatgagccaccttaagtcttgctgcagaggtaagcatctcacttgcctcactcagtccttgtcctgctttctgagcaatgccactgtcctgcagcatccctgctggtggtgggagagggtccccacaacaccagccccaatgacacaggacgacataactgcctttctctggactactattaacaaataccacagacggggtggcttataaacagtagaaatttatttctcagagttctggaggctgggaagcccaggattaaaacaccagcagatttggtgtatggtgacatcctggttcacagatggatcactgtgtcctcacctggcagaagagacaaggcagttttctgggacttctattataaaggcactaacccactcatgcgggctccacccacatgacctaatcacctcccaaggaccccacctcctaataccatcaccatggaggttagaatttcaacatagaaattcgggggtgggggacacaaacattcagaccacagcaaaaacccttatgctggtgatgctcaaggcacttaaaggcactggtaagaccccaaaaactccagtaatcacagtgcaacatgggtggaccctgatgacattatgctaagtcaaagaggccagataccacagatcacaccccgcatgattccattcaacatccagaacagaaaaacccacagggacagaaaccagcttagcagttgtctgggactcagtcggggacaggggccaatccggggtgcgacataaagggtatggtatgtttttttgaggtgatgaaaatgctctaaaattgactggggtggtgacgcacatacggtaaatatactaagaaaacactgaattttacactttaagtgggtgaattgtatgatacgtgaattatatcacaataaaggtgtttcagaaaaaaattaccaccacacgtaattactaactcatttagtttggttttaatcccttccgtgttctgcctaaacgttttatattcacacacgtgtcaccaacatcgacagtttgggaccaatcaaaactaccttcaccactgtctccccggcataaactcagggccaacatagacatgctccgtaggttggatgacacggagccactttcccgcgagtggctcaaagctactcgccaagcagctcctgcagcagtgccctcagccagcccctccagctcttccttactccagagcatcaaggactgggcacctttttgttcctggagagatgctgaatgcagtccctgccagacctgaggacaaagccggcccattattggggtgtttcccctgtgctacacactaggcgtggaagcatttggactggcattgtgtccagaattggttcccgcccgtggcttcctggtctcaccgacttcaagaatgaggccgcagacgttcccagcgagtgttacagctcttaaagattgcacgaacccaaagagtgagtgataacaaagtttattacgaagagcaagagaacagatcttccacctcctacgagcggtgtgccgctgccggttggggggcggggggggtggccagcttttattcccttatttgtccccgcccatgttctgtttctgtcctatcagaatgcccttttctcaatcctcccccacgattggctacttttagaatcctgctgattggtgcattttacagagcgctgattagtgcattttacagagcgctgattggtgcattttacaaacctagctatagggtgctgattggtgcgttttacaatcccctggtaagtcagaaaagttctccaagtccccactccacccaggaagtccagctggcttcacctctctcttccttactccagagcacgagggactgggcacctgtttgttcctggagaggtgctaaatccagtccctgccaggcctggggacaaagccagctcatcactggagggtttccctgttctgcacaatgggcgtggaatcatgtggatgggcgtgtcactgagggatccccccagcctccccactaggttgggaatgcagccatcagtgggggtcaccccaccttccctgccaagctagggacacaaacccccacgctggcccctcctagcctgtagcccccctgtcccctggggggcttacaaatgccgggacttctgagaactgagactgccttttgtgtcccctacagcagggatggcaaacacagaccacacatcccaccatttccctcttttgctttcaccctcccctccccccaccctgagtccagataacagccttagaatcctactcaacacactgttctgggcacttaatgccaggcagaggaagctggcacacaacgtgaaacctacttgccatccctgtcctacctataagtagatagggccaaaaataggagaaaataaaatgtttatgaccaaatacataaagacattgtaaaatgttgatgcttgctaggagggaattagctgactccttaaaaacatgtgtcatctactttgaaatgatcgagaaatgctggcaaatagggcagcctcagagtgctctcaagcctctgcccagtggcaggggaagcaattctctctgtgcttctgcaggaagcgacagctgaggtttgagggaggcgccagcacaccacagatatcagattcctcagtaaacagaactcacatacacccctggtgggagtgaaaattaatacgaacaacttcggaaaacacacagtttggcagtatctaccaaagctaaacatacctatacctatatacctataggtataccctacatcctataacctacagacttcccctctggtgtaaccaacagatggatgttcatccaaagcaatacacgagaatagccatgcctgtgtatccacaatagcctcacactgggaggagagtggggaaaacaaaactgcgaggtactcacacaatggaaaattggaaaccagagctacttgcaacaagatgagtgaatctaaccgacatgttgaatgaaaaaagcaagaaataaaagggtcaattacatatgattctatttataaagctgaaagccaggaagaattcttttgtgacattagaagttaggatagcaggtgcccatgaggagtgtggtatgagtgactgggagaaggaggggcggggctcccggggatgctggagatgttttacttctgatctaagtgttggttccatgggtttgttcacctgtcaagagttactaggttcagtacttacaatgtgtgctttcttctctggctatgtctgagctaacacagaggattaatttttaaaaaatacacaaatctgtctggtcgtggtggctcatgcctgtaatcccagcactttgggaggccaaggtgggcagactgcctgaggtcaggagttggagaccagcctggctaacatcgtgaaaccccgtctctactaaaaatacaaagattagctgggcgtggtggtgggcacctgtaatcccagctacttgggaggctaaggcagggatatcacttcaacccaggagtgagaggttgctgtgggccggtatcaccccactgcactccagcctgggcaacagggagagactccgtctcaaaacaaaaacaaaaacaaataaaaaatacacagtagtccaggggagagtctgttgcttatgactgagtggacctcaaggcctgcctcagtttcccacagagagagaaggaccatggtcatgaggagaccttccagggatggtggaagcaaaagagaaagttgcattttgattttggttcctccgcctggaaagtgcgggtctcacacagggaaaaggtgggcttcttccaagactcagcctgagcatctccctctgctctcggggactgagtttccctcttcctgtgagtctctctgtgccctggtacccctgcagggtcactctacccagctgtcaccccctcagagcacaaactgctccctggcatcgggtggctgctcacaactgactctgaaattagtggaaggatgtaaaagtaaaaagttggatgcaaaagtgtcacctgggttaattcaactggattgtaaaggtttcaagaaggttttgtataatgctttttactttctgcattttaagatgctttgacatcttggggtctactaatccaggagagactgccctcccagggctagctaattccttcagataataagaaactcacctgcaagcccacttttcctatgcagaccaaccaatccacagcccacacctcgaactacacccttcatttaactctcacaactaagccactatttcccctgccctaaatcatcccagggccaggtaaggtactagacaactgggggctactcctacagccaacaggtcaaaccagccaattctcacctgggtcaaacgtgcctgcacattcttccccacaaaaaccacaataaaggatctggcccatgctgtcccctagatcaggggtccccaagccctgggccacagaccagtactggtccttgacctgttaggaactgggtctcacagcaggaggcaagcagtgggtgagcattattgcctgagctccgcctcctgtcagatcatcagcagcattatattctcataggagcgcgattcctattgtgaactgtgcatgcaagggatctaggttgcacgctccttataagaatctaatgcctgatgatctgaggtggaacagtttcatctgaaaccatccctgacctggaccctcccccagttcatggaaaaattgtcttccacaaaactggtccatggtgccaatatggttggggactgctgccctagatccctctgagcttctctgtgtggtcttgcctgggtagcatggcccttcctcttggaaactgcgagtaataaactcttctttcaaagcagtggtctctgtgtctggcatcccaccgtaatggactacaacaaatcccaggtaccttttaagataggcttgcaacttaaagatgatacagccttctctaactatctcttatcccaattcatctctttcctatgtatattttcaatagacacctgtgcttcaaatgcattaagatacgtcccagaatgcaatccatgggtatgaactgtgcaggtaccacatgttactcctaacacttaggatcagatgattaatagaaggggattgtctgtaaaatatgcagttattcaggttactacataataatggaaagagtaaaaaatcaaattatttcttcagtcttttactacgaagatttctgcattttgtttttgctactgctataaatgagggaggcctcatttgtcctatagtaaaatgatgaaaatctgcccatcatcccctctacgatgaagccagtggagagtcatggtgttctgtgaccgtggtgctgtgtggcagagtgcactcaaccacctctcagacacactcgatgtgtgccctgcagccctgaggctgctccacaagcccctcccagcatgacccagcccctgttccagtgacttcagatctatgtctcacttcacttcagaattctttaggacaaatcgttttcagaatatgggaaattactttcccttgtctgattgccctggctaggacttcagtagtgtgttgaagaggagtggtcagagtgggcatccttgtcttgttccagttctcagaggggatgctttcaacttttccccattcggtattatattggctgcgggtttgtcatagatggcttttattacagtgagatatgtcctttgtatcccgattttgccgagagttttaatcataaagggatgctggattttgttgaatgctttttctgcatctgttgagatgatcatgtgatttttgtatttaattctgtttatgtggtgtatcacatttattgacttgcatatgttaaaccatttctgcatccctggtatgaaacccacttggtcatggtggattatcttttgatatgttgttggatttggttagctaatattttgttaaggatttagcatctatgttcatcaagaatataggtctgtagttttcttttttggttatgtcctttcctggttttggtattagggtgatgctggcttcacagaatgaattagggagggtctcttctttctctatcttgtggaacagtttcaaaaggattggtaccaattcctttttgaatatctggtagaattctgctgtgaatccgtctggtcctggacttttttttgttggtaatttttaaattgtcatttcaatcttactgctggttactgttctgttcagggtatctaattcttcctgccttacgctaggagggttgtatttttccaggaatttatccgtctcttctaggttttctagtttatgtgtgtaaagttattcacagtagccttgaatgatcttttgtgtttcagtggtgtcagttgtaatacctcccccgtttcatttcttattgagcttatttgggttttctctcttgttttcttggttaatcttgctaatggtctatcaattttacttatcttttcaaagaaccggctttttgtttcatttatcttttgtatttttttgtttcaatttcatttagttctgctctcatcttggttatttcctttctttttctgggtttgttatttcctttcttttgctggttcttgtttctctagttccttgagatgtgaccctagagtgtcagtttgtgctctttcagtctttttgatgcaggcgtttagggctatgaacttgcctcttagcaccgcctttgctgtatcccagaggttttgacagtttgtgtcattattgtctttcagttcgaagaattttttaatttccatcttgatttcatttttgacccaatgctcattcaggagcaagttattctgtgcagaagctctttagtttaattagatcccatttgtcagttttggcttctgttgccattacttttggtgttttagatgtgaagtcctggcccatgcctatgtcctgaatagtattgtctaggttttcttctagggtttttatggttttaggtctaacatttaagtctttaatccatcttgaattagattttgtataaggtgtaaggaagggatccagtttcagctttctacatatggctagccagtttaccctgcaccatttattaaatagggaatcctttccccatttcttgtttttgtcaggtttgtcaaagatcagatggttgtagacgtgtggtattatttctgagggctctgttctgttccgttggtctacatctctgttttggtaccagtaccatgctgttttggttactgtagccttgtagtatagtttgaagtcaggtagcgtgatgcctccagctttgttcttttggcttaggattgacttggcaatgcgggctcttttttggttccatatgaactttaaagtagttttttccaattctgtgaagaaagtcattggtagcttgatggggatggcattgaatctataaattaccttgggcagtatggccattttcacgatattgattcttcttatccatgagcatggaatgttcttccatttgtttgtatctcttttatttctttgagcagtggtttgtagttgtccttgaagaggtccttcacatcccttgtaagttggattcctaggtattttattctctttgaagcaattgtgaatgggagttcactcatgatttggctctctgcttgtctgttattggtgtataagaatgcttgtatttttgcacattgattttgtatcctgagactttgctgaatttgcttatcagcttaaggagattttgggctgagatgatggggttttctagatatactatcacagcaaaagaaactaccatcagagtgaacaggcaacctacagaatgggagaaaatttttgcaatctactcatctgacaaagggctaatatccagaatctacaaagaactccaacaaatttacaagaaaaaaacaaccctatctaaaagtgggtgaggatatgaacagacacttctcaaaagaagacatttatgcagccaacagacacatgaaaaaatgctcaacatcactggccatcagagaaatgcaaatcaaaaccacaatgagataccatctcatgccagttagaatggcgatcattaaaaattcaggaaacaataggtgctggagaggatgtggagaaataggaacacttttacactgttggtgggactgtaaaccagttcaaccattgtggaagacagtgtggcaattcctcaaggatctagaactagaaataccatttgacccagccatcccattactgggtatatacccaaaggattataaatcatgctgctataaagacacatgcacacatatgtttactgcggcactattcacaatagcaaaggcttggaaccaaccccaatgtccaacaatgacagactggattaagaaaatgtggcacatatacaccatgcaatactatgcagccataaaaaaggatgaattcatgtcctttgtagggacatggatgaagctggaaaccatcatctcagcaaactatcgcaaggacaaaaaaacaaacaccgcatgttctcacatataggtaggaactgaacaatgagaacacttggacacaggaaggggaatatcacacaccagggcctgttgtggggtgggaggaggtgggagggatagcattaggagatatacctaatgtaaatgacgagttaatgggtgcagcacaccaacatggcacatgtatacatatgtaacaaaccagcacgttgtgcacatgtaccctagaacttaaagtataataataaaaaaaaaaaatgtaaaaaaaaaaggagcaagttatttaatttccatgtatttgcatggttttgaaggttccttttggagttgatttccagttttattgtactgtggtctaagtgcttgatacaattttaattttcttaaatttattgaggctcgttttatggcctatcgggctatcttggagaaagttccacttgctgttgaatagaatgtgtattctgtggttcttggatgaaatgttctgcatatatttgttaagtccatttgttccaaggtatagttcaaatccattgtttctttgctgactttttgtcttgatgaccttgtcttgtgctgtcagtagagtactgaagtccctcacgattactgtgttgctgtctatctcatttctttggtctgttagtaattgttttatgaattttggagctccagtgttaggtgcatatatgtttaggactgtgatattttccggttggacaaggccttttatcatttgtgatgattaataccaagtgtcaacttgattgaattgaaggatacaaagtattgatcctgagtgtgtctgtgagggtgttgccaaaggagattagcatttgagtcagtgggctgggaaaggcagacccaccctcaacctgggtgggaacactctaatcagctgctagtgcagataagactataagcaggcagaaaaatgtgaaaaggagagactggcctagcctcccagcctacatctttctcccatgctggatgcttcctgccctcaaacattggactccaagttcttcagttttggaacttggactggctctccttgctcctcagcctgcagacagcctattgtgagaccttgtaataatgtgaattaataataaactcaaatatatataatatatatatatatatatattccattagttctgtccctctagagaacctagactaacacaccattatacaaatgtcccactttgtctcttttaactgctgctgctttaaagtttgttttgtctgatataagaatagctacccctgctcccttttggtgtcaatttgcgtgaaatgcctttttccacctctttaagtttatgtgagtccttatgtgttgggtgagtctcctgaaggcagcagatggttgttgagttctgatgctcctgaagcatggagttctgagtttcctgagggcagcagtgggttggtgagttcttatctattctgtggttctgtatcttttaaggggagcatttaggctatttacattcaatgttagtattgagatgtgaggtaccattgcattcattgtgctatttgttgcctgagtactttggtttttttgtttttgctttttaacttgtatttttgttttataggtcctgtgtgatttatgctttaaagaggttctgttttgatgtgtttccaagatttgtttcaagatttagagctccttttagcagttcttgtaatggtggcttggcagtggcgaattctctcagcatttgtttgtctgaaaaagatggtatctttccttcatatatgctgcttagtttcactggatacaaaattcttggctgataattgttttgtttcaagaggctgaagatagggccctgatccgttttagcttgtagggtttctgctgagaaatctgctgttaatctgataggttttcatttataggttacctagtgcttctgtgtcacagctcttaagattctttcctttgtctaactttggataacctgatgacaatgtacctaggtgatgatctttttgtgatggatttcccaggtgttctttgtgtttcttgtacttggatatctaggtctctagcaaggctggggaaaattttctctattactcccccaaatatgttttccaagcttttagaattctcttctttctcagggacactgatcattcttagggttggtcattttgttacacccgagcgagttccatggtttgcaaacatttaaaaatgaacttatgtttctaaacattctgtagctttcttcttcctattgactcattagcaatatttgttttttcctgattataaaagtaacaaatactcaatgtagacattttataaaacatacaaaagtaaaaagatgtaaattaaaatcatccataataaaaatggcttaatactgtgaaccattgtttaaaaaaaagaaaagaaaagaaaagaaaaacaccacactttgagacaaattaagagtcctttatttaagccggcggccaagagagggattgacgctccaaaattctctcagccccaaagaaggggctcgatttaacttttatatcttggtttaggaagggggggtctagttaaaacaattttacagaagtaaagtaggcaaaagttaaaaggataaatggttacaggcaagtaaacagttctaggtgcaggggctttaagacaattacaaggtgataggcccggggcttggggcgttatcaatcagaggaattcctaggaattgtggatacagcttgccacagtatcttatcagttaattgcattcttggatgtgctgggagtcagcttgcagaagttaagtccttgaggaaggggctgccagtgaaagagccaagatagaatctgtctggttctcttagctaaggaagagtccattcagatggaaacaaggctaggtgattaaaggaaaaagggagagtctaaaaacatggttagtaaaaacgaggttgggcattacaatttaacatagtcccagacttcttggaggcttcgttcatattttttcttttttctttatctttgttggattgggttaatttgaagaccttgtcttcaagctctgaatttctttcttctacttgttgaattctattcctgagactttccagagcactttgcatttctataagtgtgtccagtgtttcctgaattttttattgttttttccttatgctgtctatttccatgaatatttctcccttcacttcttgtatcatttttggatttccttgcattgggctttgcctttctctggtgcctccctgatttgtttaataactaacctcctgaattctttttcaggtagatcagggacttcttggtttggatccattgttggtaaactagtgtgattttttgggggtgttaaagttttgtcatattaccagggttggttttctgattccttctcatttgggtaggctctgtcagagggaaggtctagggctgaaggctgttgttcagattctttttttcccatggggtgttcccttggtgtggtaatctccctctttgcctatggatgtggcttcctatgagcggaactgcagtgattgttgtctgtcttctgggtctggccacccagcaagttctatcaggctccaggctggtactcagggtggtctgcacagagtcctgtgatgtgaaccgtcaatgggtctctcagcgtggatatcagtgcctgttccggtagaggtggcagcggggtgcaatggactatgtgagggttcttagctttggtggtttaatgctctatttttgtgctggttggcctcctgacgggaggtggcactttccagaaagcattggctgtggtgggtgtggagaggaacctacggtgggcagggccctagaactcctaagagtatatgccctttgtcttcataccccacgctcatggatgggtagaatcaatattgtgaaaacgatcatacggccaaaagcaatctacaaattcaatgcaatccccatcaaaataccaccaccattcttcataggattagaaaaaacaattctaaaattcatacaaaaccaaaaaagagcccaggtagccaaagcaagactaagcaaaaagaacaaatctggagtcatcacattacctgttttcaaactatactataaagccacagtcaccaaaacagcataatactggtataaaaataggcacacagaccaatggaatagaatagagaacccagaaataagcccaaatatttacagccaactgatcttcgacaaagcaaacaaaaacataaagtggggaaaggacaccctcttcaataaatggtgttgggataactggctagccacatgtaggagaatgaaactggatcctcatctctcaacttacacaaaagtcaactcaagatggattaaagacttaaatctaagacctgaaactataaaaattatagaagataactttggagaaacccttctagatgttggcttaggcaaggatttcatgaccaggaacccaaaaacaaatgcaataaaaacaaagatagtcgggacttcaactaaagagcttttgcatggccaaaggaacagttatcagagtaaacagacaacccacagggtggcagaacatcttcacaatctatacatctgacaaagaactaatttccagaatctacaatgaactcaaacaaatcagtaagaaaaaaaaaacaaacaatcccatcaaaaagtgggctaaggacatgaatagagaattctcaaaagaagatatacaaatggccaagaaacatatgaaaaaatgctcaacatcattagtcatcaggaaaaggcaaatcaaaaccataatgcaataccatcttactcctgcaagaatggccataatcaaaaaatcaaaaaatcaaaaaatagtagatgttgccgtggatgcagtaaacagggaacacttctatgctgctggtgggaatgtaaactaatgcaatcactatggaaaacagtgtggagcttccttaaagaagtaaaatagaactaccatttgatccagcaatcccactactggttatctatgcagaggaaaagaagtgattatatgaaaaggatacttcacacgcatgtttatagcagcacagttcgcaattgcaaaactgtggaaacaatccaaatgcccatcagtcaatgagtgtacaaaggaactgtggtgcataaatatatatatatatatatatatatatatatatatatatatatatatatatgatggaatactactcagccataaaaaggaatgaattaatggcatttgcagtgacctggatgagattggagactactattctaagtgaagtaaatcaagaatggaaaaccaaacatcgtatgttctcactaatatgtgggagctaagctatgaggatgcaaaggtgtaagagtaatacaatggactgtgggtacttgaggggaaaagtaggaagggggtgagggataaaggactacaaataggatgcagttatgctgctctggtgatgggtgcaccaaaatctcacaagtcaccactaaagatcctacgcatgcaaccaaataccacctgttcgccaataacttatggaaaaataaaaaataaaaataaaaaagaaaattggaaattaaagctttaagtagagaggcgagacagtaggccagaagtcgctgtgcttaatggcagcagccctggccacctgcctgatttctagggcttatttgaggctgtgggctggggagacccgctgggctggctcaggggtctgcgtgggctggctccagtgcccagcctagaaccttcagggacttggcctacgcaaagcctggcctactagttttcatttagcgcatgtgaattcagagaaaccaggatcagaaaggttcctattaggtctgttatgattctgtccaagctcattagaatttaaatttttacctttaaacgcacgttatttttggctctgcattgcatttattattatattttatgcaaagaagcctggcctttatgaccgatcagtatttgtgatttttcacttttcatgcaattaaagcccattagaacacagccacgtggcacaggaaatgcactcatgtggctgaggaaggagaggagctgccgcattctttgtttctaattgtgctttatctgctaattgcgtttctacctgctccacaggaacggtgggaaacttacatcgaaaaatatatatctaaaggaatttagaactcctttaaaatctcaaatctgatgagaatctagggttttctttggtgcatgaacgtgtatacacaaaacatttaggaaaaagttatttaattccagaaaatagaacctttattatataaattatacaattaagtcttataacattcgttgaccttttagggaaaaaaaaaaactacctgcttttcatttctagcatcagatatttcacctttattttggtcttcatttcgtcatattccgtttgctaattcatctcttgctctgcaacagatgttcaaattatttgtgaaatagtagatctgagtcacaggcttttaatttttcatttcatgtgtgccatcgtgaagagggagagagagacaggatgagaataaatctgaggactgtgggaatctgcgatgccagttggaactcctgccaagaaggaaattgtcaagtgagagcaccaagccagaatctggagttctctttgaaagcatgtcttcctaggacacagcaaccgttcctacagccctgggaatttttacaccaccttttaatgcaaatgacactttttttttttttttgagacggagtctagctctgtcgcccaggctgcagtgcagtggcacaatcttggctcactgcaacctctgcctcctgggttcaagtgattctcctgcctcagcctcccaagtagctgggattataggtgcccaccaccacgcccagctaatttttgtatttttagtagagacagggtttcactgtgttggccaggctggtctcgaactcctgacctcatgatctgcccacctcggcctctcaaagtgctgggattacaagtgtgagccaccacgaccgacactttcaaggacagcttagcttgctgagttagtaacgttcacacaagcctcctcttgaacaggaaaataagactggcactcctgaggcactcttatcacacgagagacatggaataagttagagattcctcctccctgtcttgccttcgtctccttctgaggctcttctgttaataatgtagacttgcacttttaggcccgactcagaaatttcattaattagcacggtcatcaaagtagagctccactttgctgacagaaagggagaaagggctaaagagaatcgtgctgggtaacaggaaaataaggaacactgcacgattttccaccacagagacccaagcaagaatgttcgcagcagcagtgcttggaataacaaaagattggaaagaatcgacatgaggttctgtcaagttaacttgggaaaacagtgtttcaaaaacattaaattaggagctctcctgcatgacttctccaacttgtaacatttcagtgtgtgttgttgtcagaggtgtttgaaccagagtaactccatcttggataggggctgggtaaaataaggctgagacctactgggctgcattcccagatggttaggcattctaatgaggtaggaggtcagcacaagatacaggtcataaagaccttgctgataaaacagtttgcagtaaagaagctggccaaatcccatcaaaaccaagatggtgacaagagtgatctctgggtcatcctcactgctacactcccatcagcgccatgagtttacaaatcccatgacaatgtcaggaagttaccctatatggtcaaaaagaaaaggcatgaataatcctccccttgtttagcatatcatcacgaaattaccatgaaaatgggcaaccagcatcccttagggctgctctgcctatggagagccattctttattcctttacttaataaactttcactttactctatgggctcgcctctaattctttcttgcgcaagatccaatagccctctcttggggtctggattgggaccccttttcggtaacactgtcaccctccaagaagagaggctgagcatgctgagtggaccacgttttcctcctcctcttccttcttacatttaaaataacacccatttgcatctcccgtcactcatgctcaggagaatgtgctgtgagaagtgcagaatgagatgttcaggagaggttcaggggcctgcttcagtctccagacattccagcttccgagggggccctgcagggccaccagctccctcacgctcaccccactaggaattactctatttacagacaaaaatgcctgccagttggtatttgtcctttcctagaacataccataaatacaaagcaataaagaataacgtttttatgagtttaagtttttgtctggtctctaatccagcagaatagcatgtgatacaatctcatgactttcagagctatacaggagaaaactgctcatagcagtgtcgtgtgtttccaggcaaaactgaaaacatgaatacagcactggacacctggtcagtccttaacaaattactctccgttgctcaacttcaatgacaagaacaaatcaaacaaagaagctgggcagggctgctgctgactggtcacctgacggccaatggacagtgacttttaaagtttactttcttttattcttgggggagatcatatagtatttgagggtatagttggggaacaccacattaaaaaatcgcaattcttagcttctcttgaaaagtttcgagttccaggttcactaggccgtgggtggcagccgctccctccagacaagtcctcctggttctgggctggagagagtttgtctggcttggctcccggcagcctctgggattctgtttcttcctctctgcaaagaaaggtgcccagctccaatggctctctatcttccatgtggggacacctcttctgctgtcatatctgcacctgtgagcctgttccttcgtagacatgctagcggggagtccagtggacacagacacacatacatgggttgactcagctacgtgtaactggatatcagtttagccactaataccccctaaaaatgagctataaatccgagaaacagttcggatggtcttttttcccactggagaccacacttcttgcagacactaaagccctgctaaacacaatgcgggcccagtagaactcctgtagtggcgctcctggccagggtgggggtggagggaatggaaaggtagccagagaggctggttctggagcccctgcgcctgcagccctttccccagtccctgcaacaggaaggcctcatccttctacactgcaggtatcccagcagacgaaaagcaggcactctctggagagggctcagctgacagaggactgacagacgtcccagtgcacatgaagtaaagtctgaagcttgcccgcccccagctcgcgcccagctctgcctgtgaacacagatagctccacctctgtactcagaagtgtgtccagaattgatgggttcttggtcgcactgacttccagaacgaagccgtggaccctcacactgagtgttacagttcttaaagacaccgtgtccagactttgttccttctggtgttcggatgcgttcacagtttcttccttctggtgggttcgtggtctcgctggctcagcagtgaagctacagaccttcgtggtgagtgttacagctctcaaatcggcgcgtctggagttgttcgttcctcccggtgggttcgtggtctcactggcttcaggagtgaagctgcagaccttcgcagtgagtgttacaggtgataaaggcagtttggacccaaagagtgagcagcagcaacttattgcaaacattgaaagaacaaagcttccacacttgtggaagggaactgcgccgggttgccactgctggctcgggcagcccgcttttagtcttatttggccccacccacatcctgctgattggtccattttacagagagccgattggtctgttttacagagagctgattggtccgctttgacaggatgctgattggtgcatttacaatccctgagctagacacaaaagttctccacctcctcactagattagctagatacagagtgtccactggtgtatttacaaaccctgagctagacacagggtgttgattggtgtatttacaatcccttagctagacataaaggttctccaagtccccaccagactcaggagcccagctggcttcacccagtggatccggcaccgggccgcaggtggagctgcctgccagtcccctgctgggcacccacactccttagcccttgggtggtccatgggactgggcaccgtggagcagggggcggtgcacactggggaggctcccgcagcacaggagcccacggaagttggggaggctcaggcatggcgggctgcaggtccggagccctgccccgcgggaaggcagctaaggcctggtgagaaactgagcacagcagctactggcccacatgctaagcccctcactgcccgggccggcgggctggccggccgctctgagtgcggggccgctgagcccatgcccacccagaactcacgctggcccgcaagcaccaggcacagccccggttcctgctcacgcctctccctccacacctccctgcaagctaagggaacaggctccagccttggccagcccagaaaggggctcccacagtgcagcagcgggctgaagggctcctcaagcacagccagagtgggcaccaaggccgaggaggcgcccagagccagagagggctgtgagggctgccagcatgctgtcacctctcagaagcaggagaagtcccgcccaagagaaaacaaaaactatacacactgactttcggggatctcccaagaaatgctagatgattagatgatccacccgagtccatatagctgtgacagatgatgaaccttgaagatcttgttgcattttggtggggaactgtgggaatcgggcagggaatcactttcacccgcagcttaccaggacctatctacagggatgacaaaagcatcccctaacaggtggctggagacctgaggctcaccaagtgccccagtcatgaaatcacagaaaaaaactaccagaggccagtgcattgctctccctgcctggcaggtgcaaagtcagtggagagaagtagtatcacggtcgagcatgcggtgagaacaacgcccacggaaccgggggacacatggcaagggctgaagctgcaagttctgagcacgtcagcccctgcgcctcacccccaccttcctgttctccaaactgaaatgagcctccgggccttgtccccaaccacttccctgcatcctttaggcctcggcttgcaggccaggtgctcagagaggtattggccacgtccaccacacctccccacgtctttcctcggaggacttcctgttgtctgaaactgtccaccgcagctccccgtgtctttccttggagcacttcctgttgtctgacactgtccaccacagccccccacgtctttctttggagcccgagctgctcaccagaagggagcggagccaggatttggcttgtctccaggacttgtcttgacactgccgtgttcctagcactcagaacatgccggacacggggcgctccctctgtaaaatgtattaatccactgaatcaaagaatgactgaatgtacaccatggacagatagatatttctatggaaccactgttaccttaaaacataccaatttttattttgctgggaatgtttactttgctaggaaagtttactttgctaggaaactttgggggtttggaatcaactttcaaattgcagcttttgcatggaatctctttatctataataatagcaaattcacatgaagaagaatgaaaacagaatgatgttcctacaaacggaaaaattctgggccatcatgacaacgcacaaatagctgtcaaatgctaaatttctcatgaagccaagagaggccaaaactatccctgacctgtgattagtacaataaaggctgtgcctttgggcaacaatgggaacagagatgaagacttcaagccagacagtccagcagccccagcctaaggctatgttctcctgtaatttattactcaggatgaggaagctaaatcagggttgccctggttactatggggctcttccgaggaccctggcgacataattggtgttggcttggagactgaggctttcaattctgagattagagtgctggtaatagaggtggctaccccctcaagaagaaattcaaacaggctttggaaaaaatgagatagtctcaaaattaaggtcctcctccaaaatgtgccactgactgtcttaacctgtggtcctgacagattcagcaacaatacataattggctcattcaaataataattgccttttaaaaatagtaacaaacagaatcatgaaacgcttaaccagatgatgtcagctaactgaactaggttgtcacacacagagagagcagcgtctgctgtgaatatcctgctcagatcacccttcggcagacatttcccgagttactgccacagccccgtgctggacactcagaggaggaagaactctggggatagcggcttggaggactggctggagggggaatgacatgggatgtggcccaagaaacagattttccaaagagaaagggacagtaatacagagaacaggcaggaagagggagataggactggaatatagttcattaaaatggaattcagccaggggcccttctcaggcacccagaaccctcatggctctgccaccaggctgagaatagcaaacaaaggtgatcgggtcccagaaatctgaaacacgtttttgagcatctggggatctgtgccctgtgtttgcaggctggtcttaaaggcgcctggagtttacagggggcggtgagcaaggcaggaaaagcggaggagcggcctgcatatttagggtgcaagggtctgcgatgtcaccctcacacctacacccacagtccataagggtcatcaggctcatcagctgggtggtcgctgcaggccagaaagggctgggaggacaaagcacagaacagggatgcccacccctcctgctgtcatgaggctaaatctgcttcccccacacccagccgccaccagggagagaaggagaagacggaaggaaagaggataggaggggctgaataccttctggaaagagacaaagttaatcctggggagactgttttaaactggtaaagggggaaccactctgcagtggtaagagttgaattcaatttttctaaatcagtggccacagaagtaactcacttctacatgccaagtagaaatcagttacagaaaatgaagaacacatttctgcagttctgagccaagatatgagaattttaatcacaccacatataacagaagtcaacaggattgagactaaacatctctcataaacataagtagacaaaacttgccgatgagaaaaaaaaaagaaacttgaaaacatgatgctaagtgaaagatgccagacacaaaaggacaaacactgtgccgggcatggtggctcacacctgtaatcccaacactttgggaggctgaggcgggtggatcagtttgagaccagcctggccaacattgtgaaaccccgtctctactaaaaatacaaaaattagctgggcatggtggcgggcgcctgtaatcccagctactcaggaggctgaggcaggagaatcgcttgaactagagaggtggaggttgcagtgagccaagatcacgccactgcactctagcctgggcaacacagcaagactccgtctcaaacaaaaacaaaaacaaaaacaaaacaaaacaaaatactgtatgcttccacttacatgagtgacctagaatgggataaattcatagagacagaaagtagaatattggttatcaggggctggggaagcagagaaatgaaaagttattgtttgatgggtataaagtttctattagggatgatgaaaaagttctggaaatggatgttggtcatggtttcacacaatgtgaatgtacttaatgccactgaattgcacacttaacatggttaatttagtaaactttatactgtgtatattttaccataaccaaaaagaaaaaggactctcactttcataagtagaataatatactgtttaattattaatttagaagcccaatcaaaaaaggaaaaaaagtcaaaaggtacaaattatcagtgagataacagaccttgcacacagaggaacttaacatattagaaatgtacaaaaatattgtaaaatatttactaaataatactatgaactattttatgctcatgacttaaatgatgattcaaagcccaaatagatcacaaatgtaaaaaaatgcaaaaattgccaaataactatatccttagctatcatcagtctgacagtttaattggtgaatcttttcttttcttttttaaattaaaaaatttttattaggaacatttttgtccttggtaatacttccgaataaagaaatctatgaaaatgctatggaaaattaaattaaacaacatataaaatcacctgggcacctggaagatggtgaagaaatattttgtgacataaatataaaactgaactatcaatttttaaaaagctttagtgtttcgttaaaagtatgaaaaagaaatttaaaatatgcttaaataatcattagagatatattcagaaaggaaacttattaaatgtactacttttttcattctccatggtaaaactgagaatgagaatcttggtaaaggttaaaattttgaaataatagcgtatctggggacatcaactattccttacatcttgaacacacaatctttctatttacactgtaaacatgctcagttttgaacctaccaccccctatacctgacattatctttgctctatctttcaattcttaattgagcttatggaaagagacataccaatgtctctacctttttttccccaaacctttctcctcaaaccactactatctggtttctgcttccactacatcatatctgaaactaaaatgtcaaagcaatcacgttgccaaatgtgaaaaaggatttcccagaccttttgggagttggtatcattgcttcacatggcattactaacctgtcccttcttgtacttgttttctcctggctttggatatggcattctttctgccctgcatacttctctatcattcctgtttggtctcattagctagatccttttctctacttgctcctgtagtgcagactctgctcttctcattttatcctctttttctagacaatctcatccactcccatggtttcagttgctatctataaactatctttatctctatctcagaccactttggtgacttccagcatcatacagccatccaaccatctgtgagatttctccatgtggatatccaaagacacttcaaacttaacattaaaaaaaaaatctcacataccttcttctcccctcaaatcagctgttcctcctaaaatctctaccttggctgatggttcattatcaccctgtcaagacacctggatatcatactctcattcatttctaacttagtctcaaagtcccatgaattcaacctttcaactatttttaaaatctgtccattcccacttctcaccactattgccttaggttggatccttcataatctcttaggtggactatagcaatggcctcttagatgttcttggcgtttccaatcttatttcttccaatcaatcatttataatgttgccaaaatgatctttccaatacgtaaatctgatcacatttctcccaagctgaagtaatccctacagctcttaaataattagttgcttaaagaattcatttactcactcatttaacaaatattatttaccacataacgtatgattttaggcagagaggaaattatagtaaatgaaaatatttagagaatatgcagaaaggtagatattaaacaatcccctaaataaatgtatgattacaaatttgacaaatgcaatgaagaaaaataataagtcacaaaggaagaaaaagaggagacctactagagattgtgaagttatattatttttgagagaataatatctcggtaagtttaaaaaatgagtagaagtcgctcaacaaagaagtagttttggtagagggaacagcacgtacaagggatctgaaagggaaaggagattagagtgttaaaagaaatgaaggtaagcctatttggcaagagcttagtgaaggatgggatagtggcctgagacaagattattgacatagaaaccaagtcatgtagggtttgtaagccaaggtatggatttgggttcttttgaaaggctatgggaagcaattaaaaagttttaggcagatgaatcacatggttatatttacatcttaaagtttcactctggctgctggtagagaatagattatagcctgagtggatgtgagaagactagtaaagggattattccattagtctaggagagaaaaatggtggtgggcagtctctattaacttttagaagttatctttaggtaatgtgagcctgcaacgtgaagttcctagtactttaaaagttataatgctgatgaacaaaaaggtatgtaaaaactcaggatttaatctaattagatacattttccaccattagaacatttctgctcagagatcttattacaaagctacatttctgatagtctactacgatgcagcttctgccaaagccactcagtactaacctcttacacagcatctctacttacatgattaaaatgcatatcatacttgacatagtcaaaagataaagaaccacttgatttctacttccaagctactcaactccctagtaaatggccttaccatttaccctacccaggcactgatgtaaaaaatctgagagttaatcataatttttctcttcctctcatatcccatatcatatgtaaattaagtatcaacttaaattgaatataatattcaatgtaatgctatgaaaattattgtatgtgattaatgagaatataaatctggctataaaatctctgatagtgatatagtatttatatccatatatccttaggaaaaaattccctttaattatagagtagttataaacagtagtctaatatagtatgctatagttgtgttttgccttaattattcttcattgttaatacctctataataaacatataaaataaaacgcttaatttcttagtttgcaaattaatttaccaattcgttcattctttctttgtcaagaatggaaaaccttatagcaatacaggtcatctcaggtccataaagagtaatttaagatcagaaattcatgtcaggtccatgaggaataagttttcttttcttttctttcttttttttttttttgagacggagtctcactctgctgcccaggccggagtgagtggcgcaatcttggctcacagtaacctccgcctcccaggttcaagcgattctcccgcttcagcctcctgagtagctgggattacaggcgtgggccaccacgtctggctaatttttgtgtttactagtagagatggggtttcgccatgttgtccaggctggtctcgaacccctgacctcaggtgatctgcctgcctcagtctccaaaagtgctgggattacaggtgtgagccaccgctcctggccccataaggaataatttaagatcagaagtacaaagaaagttttctaattgattttaaaattagtttctgaatatttctctaagactatagtttaaattcgatctatttcacaccaaataagtactacagcaatatttaatttctgcgttactattgacatatgagtcatctaacatgtaaactttcagccaaccaaatattatggctttagtgctaatttaaaaaaaagtttttgaaaggaacatttgtaaaatatataaaggcattcatctgccttctttttttttttaaagagatggggggtctcattttttttaaagagatggggggtctcactctgtcacccacactggagtgcagtggtacaatcatagctcactggagccttgaactcctgggctcaagcaatcctcctgcctcagccttcttagtagctgggactacaggtatgcaccaccacacccgcctaattaaattgtttgtttgtttgtttgtttgtttaagagacagggtctcgctatattgaccaggctggtctcaaacttctgggctcaagcgatcctcctgccccagcttcccaagtagctgggattacaggcggtgtgccaccacgtccagctatctgcttttttaaatagaggaagtgaatatcatgttaagttattcttaaagacttaactaagattacttatcatactttgtcacaatatatttaaaatacttcattaaattctgaggtgagatagtaaaccatttgtgctaaccctaaatagcctttttagtttttgaatagtcttcctatctccaaccttttcagatgtcccttcatgtcagaatgtcttcctctgctaatccttctctgtgctgtatttgatctgctagtaataaagcttgataaacaagtaatctgtttatttcatcaggctctattcaaggcttggagattgactctataactttcccacattgaaaagtgcaagtggaagtgggagcttctgattgatagcttttgagcttacctccgggtttgtaactgtattctttagttaaagctatcaggaatttggctaccagataagtgagacataaaaccaagtatcattactaaagcaatctagtgatacagaatattactgtgtttaaataacttatcctacataaacaacaaggtagtgttaacctcacactcacaattctgcatgattttatgacagatatctaggatttaaaaaatggatatagcttatatccattataattttgttatactgagagagttcaaagttggcatcaagggtcaaaggtagaaattagcttacatagaaaataatttgtataggccaaacagaccttttgtatacaataccacctactgtaatttagtccacaaaatactgactataagaccataatcaaaatgaaatgctatgaaaggtgtgcgagagcttagtttatgcactgtaataaagctatggatggatgggcatagcgcatctcctgttgcacgcactctgttgctcatcaagttacatggatctgagctgtttgttaaccacagaagaaggtgaatcagtctgatgatgtgtgtggtgtccagatgcctcaacagactgcctttgttcactgtctggcgaagattaaaaaggagtagaatgagggctttctgtgggagatgatgtcaaatgagcctgagctgacattgtagaggatgtagatggctgaagaaactgttcagctggagtatctacttccattgcagtttcactcacttccaaatcaggacttgatgggaccataggaagagttgaaatatctgattgacttgttccacctctgggtcaagatcttcctcatcctctattgctttgtgcaacctcacttgcttcttcgaaccgtcttgataacatatcagacattctctgcatcaatgacacattgggactctgctctccatgtcattctcgttcactctcaggccttgatctgggtccagtatctgaccaatcaccacgaaggctcaaacgcttaactggtggttgtcgtaactcttctcttctctcttccgcagaaggagttttaagttctcgtgctgtatcatctttcgggtcaaaaagatatatgtaatctgaagagtaactaatgagaatctcttgaccatcttcactgtaacacagaaatgtcactctgcaggacttattattaagatgggaagcaataaaatgggcaaccattccagtagtccctcgacctgcataattccctgtagctcttgtgcccagcattcgcctatcatatatttgtactgagctataagaacaaccaacggcaaggtaatatggtattggtgggcaaatagcaacagatgtggcagcacgtcgacagctaattaaaatatcatcttcacaatcttcttttgtgcagctagttttgatgcgtgtatcaaaccacctaccagttctatcttcaccacaagagagaaaagtgtaagggtcattgggtacagtcataatctcataagtagttccattgtggcaagtaaattggcattgtctgttggtttctgcatcttgctcaacattggtataaaatattactccatctccagagcaggatacaatctgtttatcatttgtgcaaggtaagaactttgcattagatatgtttgcttggtgccccgaacgaattgttgtcaaaacctttctgctgtagggattactaattactaatttggtgtcatctgagccagataaaatatattctccagtgtcattccaacagattgtattaacacagccatcatgcacatttagggttgcttgaagtttcaatctttagataaattctcttcttcccaggtagtggccccacagccaggacaggtcctccagcccgagggaccttttcctcatgtcccacaacagatgtgggcaggagccaccccgagacatggctctgcctgagcgaggtgggaggggagaccctacctgaatcttttcaaagtgtcataaaacagatagttctatagtcttgatatcattatagaacatttaaaaaaataaggaaagcttctgttttccaaaagcacttaataatgattggtcctgtttacaggttgtgatattttgtatactccttcttttacctttttttgctgtaagatatctgcgtggttgccttctattgtcttttcatcttgcttgtccttaacatgaaagtcctggccacaccttagcttttctttgctaccttaaagagagtctctaaacatgtgaaaattaaacaccacagttctaaataattcatggatcaaagagaaagcctcaaagaaaaaatcaagagaactgaatggacacaaaacatatcaaaatatgtggagtgcagctaaagcaatactgagagggaaatttatagcactagatgcttacataagaaacaaggaaagctcttaaaacagtaagctaattcctacctcaggaaactagataaagaagagcggctgggcgtgttagctcacgcctgtaaacccagcactttgggaggccaaggtgggtggatcacgaggtcaggaattcaagaccagcatggccaagatggtgaaaccctgtctctaccaaaaatacaaacattagctgggcatggtggcgggtgcctgtaataccagctacttgggaggctgaggcaaaaaactgcttgaacccgtgaggcagaggttgcagtgagccgagattgagccactgcactccagcctgggcgacagagtgagactccatctcaaaaaaaacaaaacaaaacaaaaaaaaacccaaagcaaacagaagaaaagaaatcataaagacaaaagtacaaatcaatgaaataaaaaacagaaaaacaattgatatgaaaacttttaacaggagttggtactttaataagatcaacaacactgacagaagtttagcaagaaaaatgctagaaaacaaaaattatcaatatctggaatgaaacaaaaatataactacagaccctgcagacatccaaaggataataaaggagtaatatgaacaactcttcacaagtaaatttcacaacttagataaaatgcatcaattccttgaaaaacacaaactaccataattcacataatatgaaacagataatttgaatagccctgtaaccattaaggaaattgggaagccaggcacaatggctcattcctgtaatcctagcacttttggaggctgagatgggaggatcgctggattccaggagttcaagaccagcctgggcaacatagtgagacttctctctataaaacataaaaaaaaaaagtagccaggcattatggcatgcacctgtagtcctacctactcaggaggctgaggcaggaggattgcttgagctcaggagttcaaggttgcattgagctatgattgtgccactgcactctactctgggtgacagagcaagatcctgtctcaaaaatttaaaataaaaaaagagaaattgaattcatagcattaaaattctccaaaataaaacctccaggcctagatagtttcactggagaattctaccaaatgcctaaagaataattaacatcaattctacataatcccttccagaaactagaagtgaagacttcacaacacattttctgaagctagtattactctgatactgaaaccagacaaagatagttgaaataaaaaaaagaaggaaggaaggaaggaaagaagggaggaaaaaagaaaagaaaaacaaccataaaccaatacctctcgtgaacttagagcaaaaaatccacaataaaatatgtacaaaccaaatccaacaatgtgtaaagattactacatgccatggccaagtgatatttgttttaggtatataaaactgattaacatttgaaaatcaatgaaatccaccagatcaacaagccaaagaagaaaaattacatgattatattaattgacaaggaagaagcttttgacaaaatgaaatgtgttttgcccattttctaattggcttgtttttcactgttgaattttgaaagttcttcatatattttagatactagtcctttggcatacatgtggctcactaatattttctccctgtctgtagcttgtcttttcaacctcttcaggtggattttcggagacctggtttttaatttttcttaacattttccttttataggtgatgattttggagtcaagtctcagaattctttgcctagcactagataccaacattttttctcctatgttttttctaaaagttttgtagttttgcattttatatttaatcccattaggttggtttttataaaagggatgaggtttaggttgaggttcactgttttgcctatgattgatgagcacatgaaaagatgcttggaatcattagtaatcagggaaatgcaattcaaaaccatcatgagatactactttgtacccactaggatggcttaaaacaaagtcagaaaagaaacgttggcaaggatgtagagaaactggaaccctcacgcgttgctgctggaaatgtacaatggtgcagctgctccgtaaaatggtctggcactttcttaaatgattcaactagagttaccaagtaacctggcaattctattccgaggtattaggttgacgcaaaagcaattgtggtttttgccattaaaagtgatatacccaagagaaatgaaaatatatgcacataaaaacttgtatataaatgtttatagcagcactgttcataatagccaaaaggtggaaacaacccaaatgtccactgatggatgagcggataaacaaaatgtgcttaatccacactatggaatattattcagacataaaaaagaatgaagtactgatacatgctgcaatatgtatgaaccttgaaaacattatgctaagaaagaagccagtcataaaagactacatattatgtgattccattcatatgaaagtccagaacagggaaatttataaagacagaaagtagactagtggtagcccagggatgggggcaaggaaggagagtgagagctaaaggtacagggttgctttttaaggtgaaattgacttcaatgatgtttacatacatctgtggatatattagaaaccactgaatattataccttaaatgggtgaattatatgatacatgagtgtattagtctggagctaggcgcggtagctcacgcctgtaatcccagcactttgggaggccgaggtgggcagatcacaaggtcagaagattgagaccatcctggctaacacagtgaaatcccatctctactaaaaaaaaatacaaaaaattattcagcttggtgggacgtgcctgtagtcccagctactcgggaggctgaggcaggagaatcgcttgaacctggaaggcggaggttgcaatgagccaagatcatgccactgcagtccagcctgggtgacagagtgagactccatctcagaaaaaaaaaaagaggtttaattggctcacagttccacaggctatacaagaagcatggcagcatctgctgccggggaggcctcagggagcttccaatcatggcagaaggtgaagggaagcaggcacgtcttacatggccagagcaggagccagacagagaggagcgaggtgctacacacttttaaacaactagatctcatgagaattcactatcatgatgacagctccaagaagcatggtgttaaaccatgagaaaccaccccatgatccaatcacctcccaccaggccccatctccaacactggggattacaattgaatatgagattcgggtggggacatatatccaaaccacatcaatgacttacatgtcaataaagagatataaaattgttttgttttttgaaaaaaatctaatattttaataagccactctctcaagccaatacaaggcagctccagcacacccctgcttcaggagatgtttatgccacatgaagggaggaaaccataatcctttccacatccctcaggtagacgtggaaataaggataaggtgaaaattacaaaaaccaagctcatcatgcctccttcccttgccaccaaatgcttgtatttctttttaacacctgttccccgggttgtataaaaagtcctttgctaattacttttaggaaaagggcgacattctggccttcacctcccagaaaccacgcatcatacttgaggcacacaccagggaagaggctgaggtcaagttcaccaatcagaaacacaaacagacaaggaaaaagaaggcagcaatcagtttccatcaaagccctcagccaggtgtcagatctcccagggacacccctctttaatttgggggggacataggtaaatatgtgtatccagaaagcctggagcaagtcgagagaggcatttgattagtatgcagatcacaggcacagctgggatcagggctaaccagactttcaaggataaacagctgacaaggatatgtcatgttgtccctgcagtgtgttgaatctaattaaaaaggacttagggtcagaaaaacactggtgtaataatgggtaagcacaacagaaatcattttattgtttacttacaggaaacaatacttttcccgtttacatgcttgacgtggccagcaaggaagagctcacacttcgtacaaaactacacactagttttgcatctctttgttgtgacacacaacctctggtttagattctttaaaattatctgtatgggacagtttctctcattattcaaagaatgacttttccccaaaataaataagatatattccttccctccgctgtcgggtgtttctcatgctctcctcttttaattgtcagtataattctagagtaaaagtcctatgtgctatggtttgaataagctccccaaaaagcatgtgttgaaaacttaatgtttggctggacatggtggctcacgcctgtaatcccaacactttgggaggccgaggcgggcggatcacctgaggtcgggagttcgagaccagcctgaccaacatgtagaaaccctgtctctactaaaaatacaaaaaattagctgggcgtggaggcacatgcctgtaatcccagatactcaggaggccgaggcaggagaatcgcttgaacccgggaggcggaggttgcagtgagcagagattgcaccattcactccagcctgagcgacagagcgagactccgtctcagaaaaaaaaaaaaaaagaaagaaagaaaaggaaaacttaatcctcaatgcaacagcgttgggaggcgggggcctatgggaggtgctttggtcagcagggctccaccatcaggaatggattaatgctgattataaaagggcttgaggctgtgagttcaatatcttgctctttctttggccctctcttgccctttcaccttctgccatgggatattgcagcaaaaaggcccaggctagatgctggcccctcaatcttggacttcccagcctcccaaaatgtgagaaataaattacccagtctgtggtattctgctatagcagcacacaacagactaagatgcactgtcaagccaaaatataatgatttgtgaacggctaacagcacaggttggaatctgatgccagctaactcccaaggtctcagattccctacctgtctcccatgcatagttgtcagaagtaaatgaatgaacgtacagaatgtgctcaagcagtgccctgcacacagcaagggctcaggaaagttagcgaccatcatatcatcatcatcatcatgatcatcatgcagtcagtattaggtttgtataaaaatatcaaagagcacattttaagcttatgtccaaacatatactaaaatgtgttaaatacgtatcttttatgtaattttccacctaaatttctagtttctgtgacaatgctaagtaggaaaaatattttaattcattcaatgctatcataatgaagattttgtttgttttctttataatgaaattagtgcctgactatatctaaatttacagaagaaaaagaacgtatattcactgaggtcaggcctgcgatagcaaaacagaggggatgggctaaccgcttctcagcaggggtaaagtactctctgctgcctttcaaagatgaagcagccccctagatatacagcaatgtatgaaatggaactttgagtagggaaaacattgcagacaaatgcatacagtataagcatatttgcttaaaaataaaactatacagttggatgactgtgtacatatacatgtacataaatatatatgtgcatacacaaaaatggatacatcataaagcaattgcctgtgtggtagggagtaggaggcagagagaggagggagactttgttttgctccagtttgtgtacttcttgcatcttttacaatgagaatctattactatttcatttcatatttaaaaagaaagggaaaatagttctattcatttaaaaccaaatattcatcaagccatataatgcattatattacattaaattgcatttcaaaagcatcctctgttatgctttcatttaaaaatacagtaagaaaagtatgatgggaaatcccaaacttctgcagaatgaattgaaataactgagtcattaaaaatcagtttatttcccagtgctttgggaggctaaggccggaggatcagttgaggccaggagttcaagactagcctatgcaatacagtgagacccccccccaccaccacccttacaaaaaattaaaaaattagctgggtgtggtggtgcatacctgtagtgccagctgcctggaagagtgaggtgggaggatcacttgagcccaggagtatgaagctacagtgagctatgattgcaccactgcactccagcctgggcaataggtgagaccctggaccctgtctctaaaaaattgttttatttgtatttttatgatttatttatttgaagacatgttctcactttgacacccaggctggagtgcagtggcacgatcttggctcactgcaacctccactgcaccccctgcgtccccctgcccccggttcaagtagctgggattacaggtgcatgccaccattcacacttaatttttgtattttttggtagagatgggatttcaccaggttgtccaggctggtctcgaactcttgacctcaagtaatctgtctgccttggcctcccaaagtgctgggattacaggcgtgagccactgcacctggccaaaagaattttttaaattaaaaaacgtgtatattttttaaaaatccattttttaaataaagttttgttgctgtcatattttaatgtgcatggagcctcaaattaaaacataatgaggcattttaaggggcatttgaaaatcaataatgctcttttctaattaatttaagtgaaacagcatgtttgcttgaaatcccaaaatgcctttttaatttcctaaggggctcttcagacaggaacagttgggaggcactcagtggttcactcacatgctcccctccaggaatggtgccaggccctggatgtgggacaaggcgcagcacagacatggccttctcccttgtgctgctttgccatgtagcgaatgatggggaaatgtcagggcttggagaaaaagagacagaatgctcagagaaccgcagagctggggagccccttggacgagggctgagggaaggcccttgcatcgatgtcccaccgactctggaatctagaggtccagaaggagccacctagagaccagctgggaggaagaacagctgtggtgcagcgtgcaggggcagcctgaagtagaaagaccctgagattctagcacagctggcaaggcagggacgtggtgcccaggagtaccactgcaggctagcgaagctggaggagccagatgaaagcaggcactcacacgccacggcgaggatgctggacagcgctccgagtccagtgggaagcacgtggctgagtttatgttgtaagaagctctctcgccatgaacacacacacacagacacacaaatatgtgaatacattttgatcacaacaagctgggaatccatgttttgttgtatttaacaaaaacccacaaaatacatccaaaaactattcctatacaaagttacagaaaattttagtggattgtaaaaagtagaaattaggggccacatgttctcatgcaatgacgttagaaattaacagtaaaaggaaagcaaaaaaccaaaaagtctaactacctaaaaagttaaggacatcaatctgagcgatgattaggttaaagagaaaagcaaaaatgaaaattacaaaccaagtggaactaagtccacaagagcactgtgtatcaacaatgccaatctatacagtattattactgttactcaactataaaagggggaaaattaacaatatgtgaattaagaaagtagaaggggttaataaaataaaaacatacatagtcaacccttccctcaaattccccatttcctcccgagacccccggctctagggaactattaatctactttgaatctctaaagatttgctaaaatgtttatttttgaactgtaaaagaatattatctgtagctttataacaataaattggaaaaaacagatgaaatatacaatgttcgaaagacattaacaaaaatgatccccaaaaagaaagaaaacacgaataacataatgaacatgggaaaatacgttaaaagtagtcaaattacctcccccaaattaaaataaacctagataattcccaggttatataaactgtttcagagcataagtcaaatcaaattcttccactttcattttaaagtatgcataattctaagatgaaactggacaaggagggcacctcaaggtaaactgtaggttatctcatttctgaatgttgatgcaaaactcttaaataatatattaacaaagtgaatgcagcctaatgtataccttctcagcaccaggaccattgcctatttctgcaatgcaaaagtgattctgcattaggaaatccattaatgcaaatcactacattaataaactaaaggaggaaagccatatgatcatcttcagagatgttaaaaggatggtgataaaatttacatgcatcttgattaaaaaaaatcttagaaagccaggatggaagcgaatacctcccattaataaaggcatctctcagaagctgatggcagacattactctacatggtaacccattaggagcaatcctgtgaaagccaggaataaaacaagggtgttaaaaaattccagtgttagtcaacctttttccctgtaaatcctcactgtgagtgaagggtcacatcgggtctgggctgacgcatgtgcgccaggaaaaatgacccaaaagttctgtcctctcaggtcactgcttccttttctcggacactgcagcgttgagatggatatggaaggctgtggtcatctcatgtgctgggaaggacgcctggatcagggaagcagcgtggtggcctgcaggccttgggcctccgtgaagacaaaagtgttataaaaacaactgatggaaaagtgaactgtggcttctcagtgagagtctcccccacgcaggcagtgaacaccgcatgtgggtgagagggaaatggagctgcgggacctcccagtgatgtgaagatgctgtccctgctgtgtctcctgtcctgtgtcctatgaagctcagcaaatggggagatttgctaatagaaaccatctctcagcagcatgcttggtggtgggtcactaagagcttctcattaaattcaggagcaagaggtggatgatgaaataccatcatctaatgttattttaacaaaacatcattatccaatgttatttgaacagttttagccacagcaactacacagaaaagcaaaacaagatgtacagatactggaaagcagaagaaaatgtaatcatttcctctgacaaactatgggatcaaagattcaggtgtacattcaactgcttgtacagttcaatgcaagtaataaaaaactgcaaaaagtcttacatgcggcgagtagcctcttcagtataaaataataactaaaacaggcatccaccagagcaagaaaatatttacaatacctaggactaaatttgaaacatggaaagttcatatgtatattttagaaaactataaaagtgtagtaacatttataacaaaataaatcctagatcgataaaacacataaatatttaaaaaataaaacccgaaaatactgaggggatagtagaaaattatttataatcttggagtgggaaaggcttttctaggaaaaacacataacccagcaatcaaaagggttaaaatacgtaaatgaataaaaccaatgtgagtacagaaaatacccacacaaagaatgccattcaaaaagtcaaaagatgcataacaaactattaaaaatatatgtttgcaaccaatataacaatagccagtttccttaacataaggaagtatatatatgtatataatatatataatatgtaaattataaaaacaacaatataacagtaaaataggtaacaaacgtgaagtggcagttaacagataaagaaatataagcaacttataaacaaatataaagatgctcaacttcacttttaattaaagaaatgaaaattacataataaaattgtacaattttgtcagattggtgaagacaaaaacaattctgacaacacacaagtttggatctgggtaaccaggcacaggctcagactgctggcaaaggtgtgaaggggtgccttgtgtttggagagcaatttaggaataagattctaaatttaaagtgcactcatgctctgactgcagggacggtcttagtgatttttttctctagatctgtttgcattccttccttgttcactgctacacccccagcacctaggccagttccccaagcagcagcaatagccactcagtatctgttgagtaatgaatatgtacaaagaatactattcaatcgggcacagtggcttacgcctgtaaacccagcactttgggaggccaaggcaggtagatagtttgagttcaggagtttgagaccagcctggccaacacggtgaaactctctacaaaaaatacaaaaaaagttagctggttgtggtggcacatgcctgtagtcccagctaattgggaggctgtgacgggaggatcacctgagcccagggaggttgaggctgcagtgagccgtgatggcaccactgcactccagcctaagcaacagagtgaaaccctgtttccaaaaaaaaaaaaaaaaaaaaggctgggcgcagtggctcatgcctgtaataccagcactctgggaggctgaggcaggtggatcgcctgaggtcaggagtttgagaccagcctggccaacatagtgaaactccatctctacaaaaaaataccaaaaaaatgtatctgggcatggtggcgggcgcctgtaatcccagctactcaggaggctgaggcaggagaatcgcttgaacccaggaggtggaggttgcagtgagctgagattgcgccattgcactcctccagcctgggcaacaagagcaaaactccatctcaaaaaaaaaaaattatttgcatgttcattttagcaaaagactagaaacatcttttaacttatccttcattaaggggtggttatatgaattatcacacatccatccagtggaattatccgctactccctgtttaacagcagagaagacctccaagtgctgatgtgaaaatgtcccaggctacatggttgactacaaaatccatgttgagtagcccacgtgtgtaaaaaaaaatccataaacaaaaatatgtgcagatgatgactggaaaggcacacacacacacacacacacacacacacacacacacacacgcaaaaccctgtagcaggaaggggaggtgctaggagcccagaataaaagattgactttagtttagatatcctttttatgcagagaacactagctagtcttaaattatgcagagaaaaaaacacaatcaccacacaaacatatggaaatgtagtaggtatcctaaagaaaaacaaaaactggagtgaagaagttgaaaagaatttggataaatcaaagcatacactgtatgttctggaatggaaagacatggtattgtttagatgttttaattttccctcaaagtaatctacaaatttaatatgatgccaattcaaatctcaaatccattctttccaagtcttggcaaaagaaaatcaaagtgcatctagaagactaaacatttaaaaccaggcaagaacattttaaagaaatagattaaaagtccgggatggggtaagcggtagaacttgtcctaccatgtataaaaatagattataaagtcaaggtaatttaagtggtattgctctggaatatgaataaacagacatatgaatgttgaatgaatatgaataaaaagtccagaaatagacaaatgggcactactatctgtgtgcgcatgtgtgcatgcaatgataacactggcagagttgatattggttgtttcttcaccacccagcatacatgtccagcttccctcccccaaccctgcttaatagcagccaactttgtttccggtatgtctgtaaaaaaaaagtagcccatgtgtgactgaattcagtctggtaggacaggtaagcaaattatcatcctcctgtatccaattaaacactccctcccagctctttgactctaatgcaaacagacccagaggtaaagaaccataggaattgtccactcctgcagaactgcaccctggcaagttcagggttcccactgtaggccccagtctcagtcagatttctgagccaacagaagaagcttccttagaaccagccagttttcaagcctgatctctagcctccttgatgattcaataggccccactatcctcacaataaatggcccgtggctttcttagtaattgtaacttgctgcaaatgatttttaatgatctgggtgacatttcaaatcagcagggaaatactagagtattcagaaaatggtttcaggtaaactactaaactgtttagagagaaaaagttcaattcatcgagtagactgtaaaatactaaagagttaactatattaaaaaaaagcacaccataaccaggaagttattggggtagcataatcttggaaaggagacaatctttttaagcatgattctaaggtaagattacaaagagaaacattggtaaatttgaatatataaaaattaaaaagttttctacttttctgacaaaaattaaaaggcaaataacaatccagggaatatatttgcccaatataagtcaaaggattcaaaactataatatataaagagctcttataaatcattgataaatatttaaatctataactgagtacagaacacatacagacaaaacagagaagaaaataaaatataaatggtgcataaacatgaatatatgacataattacacatatatgtataaatacatataagcttatgtatatgcaattataaatgactaaaaagtttaatcttactagtactcaaagaaattcaaattaaacaatgaaatcatcttatatctttcaaattagcatggattaaaaagaataacaactttcagtgctggcaaaggtgtaggggaagagcattatcatatattgggaatataaatgggtaaacttccctaaaaggcactatgtcaatatgcaccaaatactctaaagatacattcatttttatcatgtatatctaattttaggagctgtaaaaaggattcaatttgtataagaataatggccatctctctaattgcaaaaagcagagatatggttaaataaacaatgttacattcatacatatagagtagtcactaccaataaagttgtagaatattttaaaacatggaacaggccgggcgtggtggctcatgcctgtaatcccaccaaggcaggcggatcacctgaggtcaggagttcgagaccagtctggccaacatagtgaaaccttgtctctactacagtataaaagttagctgggcgtggtggcccatgcctatagtcccagctacttgggaggctgaggcagaagaatcgcttgaacccaggaggtagaggttgcagtgagctgagattgtgccactgcacaccagcctgggtgactgagcaagacttcatctcaaaaaataaataaataaaacatggaacaatgtgatcagttaaaaaagaaatcacaaggcagcatgaagtggatagcacatttaaatacattaaatatatatgtatacatacatgcatgcatacccatacatccatatacacacacattatgcacagaaaagactggaaggacataatcaactgggtggtaggactgtgaagtgttttgttttttgaatttctatagtaaatgtataatttttatatatgaaattttgttttttgaatttctatagtaaatgtataatttttatatatgaaattttatatatgaaaggagcataccttttatgtgttgtataggttttgcaatattctatgaagaactcagggtaggtcatgtccacactgaacaggtgtattagtccattcttgcattgctagaatgaaatatctgagactgggtaatttataaagaggtttaactggctcatgcaggctgtacaggaagcatgatgccagcatctgcttgacttctggggaggcttcaggaaacttacaatcatggtggaaagtgaagggggagccagaaagtcacgtggccagagcaggagccagagagaaagcaaggaagggaggtgccacacactttaaacaaccagctctcgtgagaactcactccctcactatcatgagggcagcaccgagggaatggtgctaaccactcatgagaatctgcccccatgatccaatcacctcccagcagtctccacctccaacgctcgggattgcaactgaacatgagatttgggcagggacacaaatccaaaccatatcaataggaaagggaagcaaggccgagaaacagtgagtgacttgtcctaagtcacataaccaggaggtggtgaagcatggctttgatcctggattgctgactccaaatccagtactgtttgtgctgcacacattgcccccaagcaaatgaacacactggtttgtagctctgagatttctggccttgtatgagccaaggcagagggacacctaggatcaagttctaaagtgagggaaatattgatgattctgtggtaccatcaaccaaacagatgtatgtgagagtacatatctgtggtacatgatgttctttttatgtatccgtggaggtatagaaagcggtaagaaatagaggagaccaaatctccctttcctatacttccatgcagtctgcgatgtgggaaaacggtctgagattaagaccaggaggggtcagcccttcaagcttgggcaatgtgtgtgggctttctttttggtgtgaacctccagacactgagtttcccttcacccaatcactctgtctcccccacacagagccctgcactggaaaatgagagtctaagaaaaaaatggccagttccttgtaggtcaccagattttgctatactcatagcacctagtatttaggaataaaaaggctggccaagttatgaatacaagatggcaagttatcctttcagatggagatggggatccaggttgtgtcaattgtcaatcttaagggggtctacaccataccgagaatacttctgtgcacatcatatagggatgaaatctgatcaatgttctctaggccacattcaacagacaataacaagatgaagccccaacaattcatttttgtaactcagtgggcagcttcagcatcgaaactgtgccagcgacactggtcctgctggccttcgtagataagaatgcagagagcagcaggctttccagtggctgcccctgtgaatccaaacaacatggtcccaagccaagcaggcatggtcccacagcagaaaagcttctggtaattcagcaatcacttctcagaatcatagccacaggtagagcaggcagagggcaactgtggagggacatggctctgaaaggtagcctgctattgcttccaagacaaagaaacgaaggcccatgtccccatacccagggaaccacagtcctatcaggagtttaagtatattcataccagaatgcaaccaaacacactgcaatttctgtcacagccagatgtacctattacagtaccatgagctaagttattttgaaatgatcgttctatccaacaaacaagttgttgatcttctacaacaagctcgtccaacccaccacgctgcatgcagcccaggacggcttcgaatgaggcccaacacaaattcgtaaacttccttaaaacattatgagatattttttgtgacttatttttttttagctcatcagctgtcgctaatattagtgtattttatatgtggcccaagacaattcttctaacgtggcccgaggaagccaaaagactgaatacctctgttctacaatgtacacagcacactgtctacaattttctgaatgtggcccaacacaaattcgtaaactttcttaaaacattatgagttttttttgtgactttttttttttttttttttagctcatcagctatcgctagttttagtgtattttatgtgtggcccaagacaatgcttcttctaacgtggcccaaggaagccaaaagattgaatacctctgttctacaatgtacatagcacactgtctacaattttcctggatctgaaagaaaattctttttaattgagaaatgctaactatattgttttgatatattcgtcatccagcataatatgtacatcagcacttaaaactgacttgcaaactgatttttaaaaattcaatacaaataagaatcaatgcaacaaatgctaaaatataatagttactaaggatatttattccaaaatagcactacgttgtgatccttaaaaatatactactagtagctgatttacaagaagaaaaagttttaattgttctacttataaatcagtaagtgaattgttatctaacttatagaaataaatcagcttaacctaaataccctaaactagaaaacatcagaatgaattgaaagtgtacatgagaacctaagaatacagtaaaattatttttaaaattgctcttgtacaaaatcaaatcctatgacctttatgaaagggtttgcatttcattacttaccaactggcagccttctagggagttgactagctgagcattctgacaagagagaattgaaccagccaaattcagcattacacacactgcagaaagcagcatgaaaaaggttatctggaaacaaaccaaacataaaattgattattcacttggagaggctcaaaggaaaaatgacatggctttacaacagctttcatttattatacaacagttgatcacataattacatgaataacatgtatgtgttttaaaggaaagtggtaggttatttctcaaacttccaaattcatatgatctgaaatagaaaaagtaagatctgtaggaagccatagcaagctaccatgattttgtttaaaacctatgatgataaaatatttaaggagttaaacttgaaagactgtgcattatatactcttaacagtgacaagttacacattattaaaggaaatcaagtgaaagaagtatatttattagaaggcctttaggtttaatttttattacagaaaatttcatacacatgcaaaaccaaagaaaacagcataatgaaggcacatgtgtccatcacccaacatcaataattaatccacttacggccaactgtgtttcatttacagcccctaccatctgaattattgtgcaaccaataccaggcatcatataattttacccttaaatctttctaaaggaattgagaagctttctgaaaacatagccaaaatagtcatcatatctataataaataaaaattcattaatatcatcagatactgagttcacatttccctaattgtctaaattttttcacactttgaatcaggccacacaggatacaaagcaggtccatgtggtacaactggctgttaggaatcttagacagtctatgggtttcccatccactttttcctctgtgaaatttactgaagaaaccagttcatttgtcctaaagagtttcttacagtctaaactttctgattgtagtcctctatcattaaacatttctctagcctctgtatttcttgtaatttggtgattaaatacagaggtttggccaaattcagatcaataaaaggcaaatattgtctctctctcttttttttttttttgtgatggagtctcactctgtcgctggagtgcagtggcacaatctcggctcattgcaacctctgcctcccgggttcaagcgattatcttgcctcagcctcctgagtagctgggactacaggtgcgcacaaccacacccagctaatttttgtatttttagtagagacggggtttcaccatgttggccaggacggtctcgatctcttgacctcatgatctgccctccttggcctcccaaagtgctgggattacaggcatgagccaccacgcccggccaatattgtctctctttttgtgatgttagcggccatttttaatgatgacagactcattaatttattagggtttccaaaatagtgctagtctcactctgtcattttttctttatgaataagaatacatatagagacacagacttttcctcatcaactgttttgttaccctgaggtatagttcatatatgaaaagcaggatatatacttgactctttctgttcattttccaggctttaaaataattttaaattttgcaaaatgaactcaaggaagtctgtatgcttaattagcactctttctgcacctatgtaaataattaggccaaatctaatgaagaaagaccctttttgtgatggagaataacctttaagattaatctgatcaagaggcggggagactggcattaaaacttgttaaagagcaaaaaaaaaaaaaaaaaaaaaaaaaaaaattcactggatattctgtctaatgcacacttcagggttatttctgcctttcaatgtctttatgctatttcaaaactctgcataaaactgataaaactgatagtttatcaactgatagttgtataaaactgatagtagtgcaaatgattcttgacgatacaaatgtaaaggaattttgtccagtagaacgtaactgattattgccccactgatattggccacttttacatttatttgtaaatttatttcagcattcctgattgcttatatgtgtgcagtgtttgaattaacctttgaactgcttgtaacatcttactgatttcctcattaaataatgagttagacatagtctttgacacatgtctatttttttaaaaagctgattcccggccaggcgcagtggctcatgcctgtaatcccagcactttgggaggccaaggtgggtggatcatgagatcaggagttcgagaccagcctgaccaacatggtgaaagcccatctctactaaaaatataaaaattagccgggcatggtgctgcgcgcctgtaatcccagctactcaggagcctgaggcaggagaattgcttgaacccaggaggtggaggttgcagtgagccgagatctccagcctgggtaacaaagcgagactccgtcaaaacaaacaaacaaacaaaccaacaaacaaaaacctggttccctagcatcctccaaaattaacaatatcatgaaatagtattttgtctgtttggtggagaggggagtgagtttgagtcattatgagccaagaacttaaacacatttgatagttttaatcatctgcatcattagacagagtccactcaagttgacacctgggtcctttcaacacaactccagtagaccttgacagctatctggctttctgtatgagaagatagtacaggatcatcttacagttttctacccaagagacctataatcagccatttctccagtaagtccaggttccattcaatgagaatggtattcagataccataatttttgtgctacaggtgctgtttgctacttggagcttcattgttttcagttgtcagacatatcatgagttcacaattatgtttctgatttaaattcaacactactaagttttcacaatgagataccatctcacaccaggctattactaaaaagtaaaaaataacatgttagcaaggatgtggagaaaagggaacacttatacactgttggtggaaatgtaaattagttcagccactgtggaaagcaatgtggagatttctcaaataactaaaagcagaacgaccattcgacccagcaatcccattactaggtatatacccaaaggaaaatacattgttttgccaaaaaataaaaaaccccaccttcacccatatgttcaccacagcattattcacaatagcaaagtcatagaaccaacccaggtgcccatcaatagtggcttggataaggaaaattccatggtacatatacaccatggaatactacgcaaccataaaaaagaacacaatcatggccaggcgcggtggctcatgcctgtaatcccagcactttggggggtcgaggcgggcggatcaaaaggtcaggagattgagaccatcctggctaacacggtgaaaccctgtctctactaaaaatacaaaaagttagccaggcatggtggtgggcgcctgtagtaccagctactcgggatgctgaggcaggagaatagcatgaacccgggaggcggagcttgcagtgagccaagatcacgctactgcactccagcctgagcgacagagcgagagtccgtctcaaaaaaaaaaaaaaaaaaggaacacaatcatgttctttgtagtaacatggatgtagctggagtccatattatatgaattaacacaaacaaaaccaaatactatatattctcacttatagggtaggagctaaactttgggtacacacagacacaaagatggggacaacaggcactgaggactccaaccggaggttggggggaagagctgaaaaaccacctattggggtactgtgctcactaactgggtgatgggattatgagaagcctaaacttcagcaccatgcaacacacccaggtaacaaacctgcacatgtacctcctgaatctaaaatttaaaataaatatagtcatacataacaaaaaaaccgcaaacaaaactataaggtttttatgtaaccatattaattttacatctgtatctcctttcaaccatgccaaaaactatttctcaacataattaatctgttggatttaatttcacaatatccacacaacagtctcaaaataacaccaatacaactgccgaaaaaaatgactgaaaatagtttaacatttatatttctttttattcttacattacattctaccagaaatagtcaaattatggtgttttaaactcacatggttcctttatatgtggttacgctactgatcaggaacccaggttcattccttttatttcattttttcttgtttaagaattgtttctaaaactgagtttcatttctaattacataaaatgattccaaagtcaggtccataaatgaagtttcacataagtctggcatttattctgttcctccactctatttcctcccatttattaataggcaagcatttattttttaattttatattttatcctcccatcattttttagtaaaagtatataatagtagcataatacacacattttctttacttactttttttgcacttaatatggtgaagatcactcgaaataagaacacacaaataaccctattcccttctacaactgcctaatacttcatggcacagatgaatcacagtttatttttttattatttatttatttatttatttatttatttatttatttatttatcttgagatggagtttcactcttgttgtgcaggctggagtgcaatgcagcgatctcgactcaccgcagtctccacctcccaggttcaagcgattctcctgcctcagcctctcaagtagctgggattacaggcatgcgccaccacaccggggtaattttgtatttttagtagagacggggtttctccatgttggtcaggctggtctggaacacctgacctcaggtggtccacccgcctcggcctcccaaagtgctgggattacaggcgtgagccaccgcgccaggccaaatcacaatttattaagccagatccctactgatgaacatttgggttatttttagtcctttgctatttattataagtagtgttgcaacgaactgccttgttcatatatctttttataggtttcccagcatggctttgggatatattcttagaagtggcattgctggatcaacggataaatgtttgtttaatgtgctagacattaccacattcctcatcatacgactggtactatttttcattcccactaacaatgtatgagaaggataagatcttactttttctgttaataccttaaaaatgtaagctaaattaaatttaggaaaataactggtattaccattctctaccgtaactataatgtatacccctcagctgtagttaaatttattttccttaaaaatgtacatgggagacagaattcataagaggatattttgttcatttaggaactatttcaagttcataatgttagcagtatctcagcaatggttttaataactgcagagtctgacagcatcccttgggaaagttaggtcacatagaaagggccaactttgctgggcgcggtggctcacacctgtaatcccagcactttgggaggctgaggcgggtgaatcatgaggtcaggagatcgagaccatcctggctaacacggtgaaacccctgtctctactaaaaatacaaaaaaattagccgggcgtgctggcacgcgcctgtaatcccagctactcaggaggctgaggcagaagaatcgcttgaactcgggagatggaggttgcagggagccgagattgcaccactgcactctagcctgggtgacagagcaaggctcagtctcaaaaaaaaaaaaaaaaaaaaagaaagaaagaaaaaagaaagggccaacttaaatttttcatattagaagttacggcagtcccatatcattcaaatgatatgtaaataaactggcctgcacagctttgaaattgaggtcaaaaaatagttgctgaaaacatcacgaaagcaaacctacacagaagccaacaagagactaccctgagacttagtaagtgctgaacaacacagatgctacgaaagtcaaggaggtaagagacaataagatctttttgcctgtttattgtttttttttaattgtggtaaaatatccataataaaaacgtacttgcattttctaatttgttttttaaactgtggtaaaatattcataacatgaagtttacctttattcccatttttatgtgtgcagtttaatgacattaagtatgttcacactgttgtggaatgatcatcactatccatttccagagaatgttttgtcttctcaaactgaaactccatacccattaaacaatcattccttatcctccctcctcctagcccctagcaatcaccaccattctactttctgtcccttgaaatttgattactctagatatgttacatacgggaaatcatacagtactcttcctttggtgactggctgatttcacttatagcataatgtcttcaaggttcatccatattgtagcatgtgtcagaatttccttccttttcaaggctattcgaataatattccattgttccagaaattggtcctgccaatgaaacaacttttctgagtgggcaagaactttgaatcaactatttcataactctggaagctggctgaacacttgtagcatccagagggataatctgataaagaaagaggttggcattcaaggaaatctccatcaggtctttggctgaccatggatataatggaatagagactttagtgatcacacacaatgaggaataaaatctgctcaaaattagtttggaaaagtcactaaagaaatggatggctacagctctcaaaaagcagttatcaggcatcattaaggagggaagataatctgatttcagagtcaccacattacaatattcaaaatgtccaattctcaaatatttccttcttgaccaatctctagcacttgaacaaaatattaacatagattctaacagctcaaggccacatccctaggatggctctagctccccctaaagtacctgcctgagaaaattcaaggctgccaaaagagtttactgttagttccagccgacacttgaagacaccctgtgtcccagcatctgtgggagggtaggagcctaactttgataagcactagctaacaatcccagatgggtttcacacaggccaatccctactttccacttttggtaatttttcacttccttgactttactaaccaccccctacaccctgctcaccctccctcctgattcttcattcttcctttaaaacacctagtgaagcctggcacagtggctcacacctacaatcccagcacttcaggaggccaaggcaggcagatcacttgagcccaggagttagataccagcctgagcaacatggtgaaatcccatttacatatatatatatatgaagaaaaaaatgcaattattaaaaaatcaaaacaaaacaaaagcccagaaacctctgtacaaattgaagttgagttcagttaacaccgggctcttttccatagtgtaacagtttattactcattaaaatctgccctttccgttttaactggtgtccagctttgtgtatctctggcagaaacacatgaattaacaaaagtgattcaagacaaaatagaaattctcaatatctgtataacaaggaaggagactgaatcaggaatcaaaaatcctcccaacaaagaaacgtctgggcctatttggggtctctggtgaatactctcaaacatctaaggaattaacaccagtcttatgcaaactctctcaaaaactgaaggagagggagcacttcctaactcatttcatgaggcaggattaccctggtaccgaagtcagacaaagacactacaagaaaagtaaaccatagactaacatcacttatgaatatacacagaaaatcctcaatacatttcagaagattaaatcatacaaagtacctactctgaccaaaataaagtgaagttaaaaatcagtaacagaaagaaaactggaaggaaacaaaaggaaattggattctactccgtgaccaagtgggatttacttcaggaatgcaagaaagtcgatcaatgtaatacacaacatcaatacattgaagaagaaaaaaaagcacatcatcatctcaacacagaaaaaccatttgacccaatttgagaattcttatctttcagagacacgtgccaaaatatttacaggtaaaatcatatatggcatttgtttctaagtaatctggactagggaggaatacaaagtagttgaactgggtggggatacagacgaaataagattatccacatattgaatcttgtacctcatctttctactttcacgtttgaaattttctaaaataaaaaatttaaaaacagatgaaaagacattttaagagaatacttttaaaataaggcaggaaggaaactggaaatatgttaatataatactaaaaagcattattaggaataaagagagtctaaaagcaacaattctccaggaggagataatgatgctaaacctgtttcgcctttacaaatacagcctgaaaatatataaaataaaaaacaagacttaacaaaatcataatgagagatctttcccattgcttagaaatagattacgcaataaaaatagactatataatatttgaacaacacaattaacaagctttaggtaataaacatactgtgaacatatcaaaaacacgtacacagctgcttgggaggctagcgggggaggactgcttgtggtaaggagctcaagaccagcctgagatacatggcaagatcccatctctaaaaaaatagttttaaaaattagctaggcatggtggtgctcgcctgtaatcccagctgatcaggaggctgaggaaggaggatcgcttgagcccaagagttggaggctgccgtgagctatgattgtgccactgcattctagcctgggcaacaagcaagatcctatctctaaaaagttttttaaaaattagccaggcatggtggcgcttgactgtagtctgagctaattaggaggctgtagcaggaggctcacttgagcctgcttctactgcactctagcctgggcaacaagcaaacttctatctctaaaaaggaaaagacaaaaagaaaacatactgaattcacttcttttttaaaggacacttggaacataccaaaagctaaccacatattaggccaaagaccatgttaaaatattttaaaaactgattttatacgcaacattttatctcactcaaagcaattttttaaaaaatcaaagaccaacaacaaaaagcatagttcaaatccaaatattggaaaatttaaaaagatcactcacttgcaattagaatcaaagacaaatcaaaacagatattaggaaatatttagcattgaatataacaaaaatacatctgagaatttatcaaatatgagcaatattgtaaagataaatatattgccttaaatgaattagaaatgaaaatcaattgactaagtatctactccagaaataaaaaaaaaaagaaccactaagtaaacccaaggaaagtaaaaagaaaggaaacataaagtaattaaatcaaaaagggaaacaataaaaaagatcaatacaacaaaagtttcttgaaaatactgataaaataaataaactcccagcacaaatggctccagaaaaaaaaaaaaaaagggcgaaggcaaaaaataattctgggagtacaaaaagaaagagaatctataagtaaagatgcatggtgttatgatatatacatattggtttccttccatggttcctgtttcctaactcccataatcttcgttatactgttggggttctttaggcctcaggcaacagaatctctctctctgaccttctcctgtctttctttcatctgccccagtcaggcctctgattgtgggtcaaaagaccctcatttcagaaaagagtcctgccccaaaccctagaggaaggaatgctacacagagaggccaagaaaactctgagcagacaggccttgctggctttagctcgtgtgcgtttttgtccaatcacatttctgcacagttgtcaatcatgcctatgtaatgaagcttccataaaaacccaaaaggacagggttcagagagcttccagactgctcaacatgcggtggttccggtagggtggcgtgcccagggaaggcatggaagctccacacaccttccccataccttgccctatgcatctcttcatctgtgtcttttgcaataccctttataataaaccagtaaacgtaagtgtttccctgagttgtgtggactgctcttgcaaattatttgaacccaaagaggacatcatcagaaccccaacttgaagaccattggtcaaaagttccagaggcctggacttgtgactagtgtcctgagagtgggcagtcttggggactaagccctcatcctgtgggatctgacactatctccaggtagatagtgttggaactgaattggaggacacccagctggtatctgctgcttcctccgtaggggaaaccccctacacatttgatcacagaagtcttcttctgtgttgatgattgttgtggtgtgagagcagaggaaaaacgaagtttgagagttttttctctaaaaaagatgtaaaagaattatttttaaatcaaaggacaatactaagaaatgctttctactaattatatcagaaaatatatgaaaacatcttctagaaaatacaagtgaccaaaaccaatttcaaaagaagagaaaacctgaacataatcttgagaaaaatatcagtaaaaatctacccacaaaaaacaccaggcccacagcctttcacatgtagatttgttccaaactttcgaaaacatctaatcttctgataacagggcaaaaggcaagcttcccaatgcatttataagaccaaaaggttttctatttcctgaacaattcagtgcaatagctgttaagtgggacagaacaagttccatgtcctgggagaggccaaggtcacctgagtggggttagagctctagcaatgggtggagggtgactgcacagaaaagccagttatgtgggacattggagcccacgtgggaagctaagcgcacccatgtggatggtgtggcagagaggatagtggattggttatttataagaggaattaatcaaataagtaaatatggtaaagataataggtgctaagtttctcaaaccagaatacacacagcggtgctgtattgcaaatggcagtatcagtgtaatctcatagtcttcagtgctgtgtagatgactgatagataaatatcctataacttcatcacctagagggctggaagcaatgatatttcccataggcatgagcaaacctagcaaccttgtttctgaattccattctccaccaaaagaaaccggagctctttaggaaaaggattaattccaggcctagggcagggagagttaaagtctgaactcctgggtgggcgcggtggctcacgcctacaatcccagcactttgggaggccgaagtggatcacgaggtcaggagattgagaccatcctggctaacacggtgaaatccccgtctctactaaaaacacaaaaaattagctgggcatggtggcgggtgcctgtagtcccagctactcgggaggctgaggcaggagaatcgcttgaacccaggaggcggagattgcagtgagctgagattgcaccaatccactacagcctgggcgacagagcgagactccgtctcaaaaaaaaaaagaactccctctctttttgtgccaacaagcaaggaaatgctcaataaatgatgttggggcatgttaaagatgcaaaagccagctttaaggggctcccactggccaaatcagggacaatttgagtattgaaatatgtaatgataataaaagattagataataagttaatgataataagagacccatgggtctatacaaagtctcaaagtgtctccacacaagttatttgtttaccttaaaggagaaaactctgcagtggaggcacatgacagaaatccaccttaaccaaagtgatcaaggtttcaaaataacaggacaaattgaaattttgtgccacctgataggatccaaaaataacacagcattgcttctgtgatattcttcccaaagatgcataattcaaatccaatcatgaagaaacagcagacaaaccccagctgaaggatgttctacagaaaacaggcccgtattcttcaagtgaaggtcataatagtcaaggaaagacttaggaactactggcaataggaaggagactaaagaaacataactaaatagttcagggaacaaattattttgcactgggcttgcaacttttctgtaaatttgaggttatctctaagtaaattagcataacctcaaaaataatgataatataggaaaattaaagactaacccccccttatgtcaaaagatgcaaaattatacattttgagctatatgtatttaaaaattttatcaacaactgtttgtctccaaaatgcaagaatgtttagatatcagaaaactgtatgttattacaccaaattatatgccccaaaaaacaaatttacagagtaaataagacattttaatcatattagcaggtaaataaagagcatatatacatccaaagtcattcatagttttttttctgaacatctctaagcaagctaggactgaaggggtaactaaatagcccaataaaaggtatttataggggaaaaaaactcttaacagcaaacatcacactctatggcaaaacttaaaattatttcctttaaaatcaagaataaggaatcagaaacatccttagagcctgctgtaactgcttcttttcaataatatattgcattttcagccaatgcaaaaaagactaaaataaaaggctttaagaattgaaaaagaagacaggcatatgatgctaaagaattataggctgggcgaggtggctcatgcctgtaatcctagcactttaggaggccgaggcgggcagattacctaaagtcaggagtttgagaccaccctggccaacatggcaaaaccccgtctctactaaaagtacaaaaattagccggacgtggtggcgggcacctgtaatcccagctactcaggaggctgaggcaggagaatcgcttgaatccaggaggcagagattgcactgagccaagattgtgccaatgcactccagcctgggcgacaagagcaagactccgtctcaaaaagaaaaaaagaattacagtatggtatttgcaaatggatagcaaataaaccaattcagtcctagccataaatttatctatacatgggacattgctacaaaatactgagtgtcataaatcagtgtggaaagtataaatgatgaaaaactggtgctaggctatccatataggaaaaatacaaaaactatttccatacctcacatcatacacaaaagcagattaaaagcataaaatgtgaagatcaaaactttgaacacttagggaaaaaaggcagaaaacatatttacaattttaggattaggggaattttttaaagcactatacacaaatgtagctcttataaacactaatgatcgtaacacatttaggtcaaatgatctgtatgaccaaaagaagtgaaaatgtgggagaaggtatttgcactagatagatagagcagaccatggattaacatgtagaacatataaagatgtcttacaaatcaatagaaataggtctaagacatgaaatctgacactcaaaaaggagtgagagcaaaagataggcagatacttaacattactagtaagcaacaggtataagttaataccgtaataaattatcatttcacactgtaccagaatggctgaaaagatactgaaaaggccaagtgttcacagggggtgaaggtggagggattggtaaacaaaaacaaaacaaaactgtataaaatgttgatgggagtgtaacttgacacaagctcaagagcagcttggcaatagtccttgattgctccatttgtttctggctggagaaactcacacatgtgcctaaagaagtactgtacaatgcctgcaaatctcaaagaactggaaagaccttaaatgtccagacattaaggaatggatagttatttttcccccataaaagaacaattaaaatgagtgaatcaggtctacatatatccacatggctgaatctcaaatacataatggtgagtgagtacagcaagttgcataaggacacacgtaacaccgcttatataaatcatgaaagcccacaaaataaaactctatattggttatgtatatatacatgtatagtaaaattataaagtcatacaacagcccgatagccacagacttttgttacctctggggagggtgagaaggaaaagatataaggccttgatgtggcctctgatgtttcatattttaaaatttgaaacaagattatcgatggtaaattgctaacacctctgagaaaagcggggggaattttgcctcagatataactggtggtgactgctgggtaataatttttattatacaggtgagaatgcgagtatcagagggcatgaggaggagaaagctgagtcagggaggtaaggggaccaggaggcaggaaggagtttatacactgaaataaaatgcagatcaagaagaaatgcctgtaagggccaaacatattccactgatgaaacaaatgcaaatcccaattcaacagaatgaaataaaacccagtaacctatcacattcctccatactcactatagactcttttaaatgacattccgtccagtgttgatgaagttcacttttttccccgagttaaaaatatttgccttatttcaaggttaatttgcagcacctccccctaaaacaattaacttatttgcccactgaataaaacgtgttgaatctctgcattaaaaacagcatctgctacacgtaatggaggaacacaatgggactatgaactcttctagttcatttagtgcataaaactattatatagctattatttttctcattttacagataaattgagattcagagagcttaaaacctacccccacaaccaccatgctgacaagttagcatgagccgtaattcaaattcagtttgccagacagccccaagacccatacccttttccctatacctaactccctaggaggtagatcttatgtcctgctcttatgttctatgtggggcacactcaccatacacgttatatttccccatacaatagagtgagactagaggactatcttttgaaccaggaattgctctcctaggaatgatttggaaaaaaagataaagaaaagttatatttaaaaagtggcagctccagaccaaggagaataaaaaataaaaacattaaagaataacaaataaaattctccacatcacggactaaaaccattttacaggtcaagaaacatctgcatacaaactaaggaacctatgtaaattcatatactagttatggtggggccaggatctcaacccagacagtccgattcccaaacaggcatggttaatggttacgctattgttttataagcctttttgagatccacagtgagaaatatatttcacctcatgatcctgattttgtttcacacaaaagtgaaacaacttctacaaaacagcattgaccttaatatgtagcaaaaactttaagatgttgatttccagtcatgaaattctctcatgacccacgatttaaaaaacacacaatgcttaagtgcttcaaaaatacagtatttattgtaataactacagtagcaagaagaaaaaaacgaagtggaactacgtgtttagcagcagagctgaataattatgaatataaacaattactattgggagaaaatacattacactcattgcttggaaccatgaataatacttatatatgtacgaaatatagaaaaataaaataggttaacataataaggatataggcaattattttttttaattttataaaaacttttatttttccttacaaactggggtagttaggagacctgataatagcttttttattttcttggcaccaaagcaacttacttatgtgttccttcttgcattatctgttccagatcatagtcaagttttccaattcgttttactaagctagcaaaattttttataccaaaaagagtaaaatcaaaacaaatgctcctttgtttatagatgaaaatctggagcaaaataacacaacattaaaaaaacaaaactttgcaaacacatcctaaagctacacacattgaagcgtttacagcaatatgctccctgggttcgttctcccttcccccaatcctctaaactgtgcctttgggtctcagacccttgtcccgggggtccctctgaatccacctttcaagaggatggagctgggccactaggctgaggtctggccctgttctcctcatctgccaaagcctcacagtactgcgctggccagtccttggggtcttgattatggaccttggccacaaacttaagaactttcatcttgctggtttccaggttggttcgcgggccccactggaattcgtagtcgacggggtcggtgtggggtatccgccggtattccaggtaacgctgtcgcacaaagtcctcagtaatgagtttctttggatctccgaaaattaaatgcttcttggtggggtagacccctaagcgccgcagaaagtcccaggcttcagtttccttgatggtgttgcccttcataaagatgagccctaagacgatcatcaggaggcccgtagtgggcgtgccttggtcacccctcatctcggcatcctcctccacaggctccagggtgttgatgaggatgtaagtgttgctcttgggttcaagttccaccagcttatacccgaagacgtactggaggcgctcggcggcccgtttgaagaggtcggggaagatgtccttgtagtccccgatgacgtgcttcagtatgtcggcccgcttgatcggaatcttcttctggtctttaatcagcaagaactgcaccagctcggacactttcagctccagctgcttctggctcctgggccccacggcgggggcggcctgggcccggcgggcgccctgaggcgaggggccctgcgacccctgcgagccgcccggcccgcgggacgtgctcggggcctcctcggcaaagccgtctctgagaacccgggcgtcttccccggcccgcgaagccccggggtttccgctatggctccagtctctgtccctctcggcctggccgccagagcggccccggttcctcggtttttgcaacatgtctccggcggcaggtgccggcgcacactccggtaggcaagcagccgcggcggggattgcgggtcggcgacccgctaacgccggtgcctggaggcgcgcgcagtgtcggctgagactgcgtgctgcgtcatgaagcctgcgccttgcgtcagggcggctgggcggtgcgcctgcgcggctgcggcgggtaccaaaaggaacagcgttttccgtgcagccctgcaggtccgggcgatgatttttagtatagtgaagtgttgttaccaaaccatgcaaacagagagcgagaaccgaaactcctaaacaagtgtgtcgctaaattcagaccacacaggctcaggcaagttttacagacagtattatgagtttctaaatcgggagcatttgtaaacggaaagaattcagaggatgaacgtgtgagaaaaaaaaaaggtgaagaggaagggccgaccgtggaagtaaagtaaaaacatttatttctacacaaaatgtagaaggacataaaagacccagagggctcttagttttcgtccctccacccaatttcataccctccatcccactgcccccagttactttctctaatgccccgtggagtctgttaaaaaccaaagtcggctgcaggctttctgcgcaagcaggacttcagtttcactatttccgtatttatattctctgcattaaactcctttagctagacaactatgagaagaccacaaaaaacgtgtcagtattaggtaaatgttttagcttggtcacatgggtttatcttttggaaaacaactgctttcgtcacaaccacaattttagcagaaatgggtaagaggaatgctgcaaacaaacgtgcactctcaagagattactacttaatttggggcatcactgatcaagaattgcaataatgtggagctcttaaatttcttaattcataatatattagctttgaggaaaaaaaagagaacactgggggatttatctctcatctatgatgtgatatacagtctctactgtatattttaattgtgcaactcaagtagccaaaatgagtcatttcattaactcaaaccatcagcagtctgctgccatgacttctacagatcttagcaaatttgtttcttctctatttacttgcaaagaagaaactgaatttccctgtgtctttttaaagctacccagaaagtggataaactcttcaaagaaccaaattgagttcctctttaatgcaaatatattcaaaggaaagcaatttagaacacattatctgagtaatagcatcaaacacaaccttattaaaattttgttaattgttagtagcataacacttttgtttgtaattcagtaggaaaatgcaatctgataatggcactggaactgcaatagtaaatgtaaaatcatattccatgaactaatgcaagtatgctaaaatctggtatgcaatgagtaataacttactgttccacacaagatgcaactatatcctcaggcatcaattttaatgacaaaggcctactatgaaaaacaaatatattatcaaggcattcatttttttacaatgagaaaattcatctgcttcagtttccttgcaaattaaaatctggacttaggttcatagaagcttcctgccatctagaattctgcaaaaggtccctactgcaggatgtggatgttgtattgagggaatagagagaccgtctcatattgttttatattgttttatactcagtacctgttttaagaaaaaacaacaaggaagtaaaaccaaatacaggcagcccagcgccaggcccaaaaccaggcctgggcctgcctggcctaaacccagtagttaaaaatcaactcataacttagaaaccgatgttattcatagattccagacattgtatagaagaacattgtataaagaacagaactgccctgttctgtttctctctgaccaccggtgcatgtagcccctgtcacataccgcctgcttgctctgatcaatcacgaccctttcatgtaaaatctttagtgttgtgagctctttaaagggacagaaattgtgcatttggggagctcggattttaaggcagtagcttgccgatgctcccagctgaataaagcccttccttgtgcaactcggtgtctgagagattttgtctgcggctcgtcctgctacagtgccttgagtcaaaaaagttcagtgaccgagatataaggggaaagtggaaaattagataaaagctattgtcaacagttgggctggtttttcagtgctctttcttgctaaggtattcatgtacgttaccaagcagcccaccagtcagactacccctgtcactgtgaaaatcagcagtgtcctccagcagcacgcttacctagatagcagactgtcattactcaagatagaggagaagagataccagtttttaagtctcaaaacatctctctacactctttccagaagaatgcaggtgagaaaatgcagacataaaataagagtattagaatgaagttttaggccctgcatggagaagtcatccagacccacattccaccttggattgatactggaagccatggatgtctggggagaaactgtggtgataacaatactaacattagtaacaataaatataaccgacaacagccaatgattatagtagttgctgctccatctccatgtctgcagttttactttctgtggtttcagttacctgcagtcaaccacagtccgaaaatattaggatattttcaaagagaaaccacaatataacttattacactatatttgttctactttattgttagtgtcaactgaaggatgacgaggttcataaatttggaaagagctttatttctcataaagggttgcagtctgcggggcggccattccaacaggctaggaagacaacctcatgctagaagccagaaacagacacttcaagggagggcaaagggagcaggaatctatgcagaatggggtggccaaatatacatatttaataagctataggaggagtcatgaacatttatgcaaggagaaatgtgcatatgcgcaattgcacttcatgtctctccctgggacccatattccaaaattggcagtgttagcatgatccagggtaggagttttcagccctctgacatcaaaaggtgaagtagaggacatgaaaaccctgactgcatgtcttccatagactggccagaactactccatggttggtggtcttttaccaggaagaactgctggtcaattgtgccaaaactgcaaaagggaggggcagcatcaggtggttggtttataccagcagtggagtcttttgaaagggctgatttctgtttagctcttagggaagaaagcctaatggcatttagagcgggtgagggtttccaaggttattcggggtccccttggccaagagggggtctgttcagtcagctggagggcttaagatttcatttttctcatcaattattgttaatctctattatgactaatttataaattaaactttttttttttttttttgagatggagttgcgctctgtcgcccaggctggagtgcagtgtcacgatcttggctcactgcaacctccgcctcctgggttcaagagatcctcacatctcagcctcccgagtagctaggattacaggtgtgtaccaccacgtctggctttttttgtatttttaatagagatggggtttcaccatgttagccaggctggtctcgaactcctgacctcaagtgatccatccacctcagcctcccaaagtgttaggattacaggtgtgagccaccgctcctggcgtaaattaaattttatcataggttcgtgtgatgattaatgtggagtgtcaacttgattgaaggaagcaaagtattgttcctgggtgtgtcagtgagggtgttgccaaaggagattaacatttcagtaagtggactaggagaggcagacccacgttcaatctgggtgggcaccatctaatcagctgccagtgcggctagaataaaagcaggcagaagaacgtggaaggacttgacttgctgagtcttctggtcttcatctttctctcatgctggatgcctccttcccttgaaagtcagactccaagttcttcagcttttggattcttggacttacactagtggtttgccaggggttcaagggtcttcagccacagactgaaggctgcactattggattccctacttttgaggttttggaactcagactggcttccttgctcctcagcttgcagatggcctattgtggggcttcaccttgtgatcatgtgagtcaatactctagtaaactccctttcatatatacatctattctattaattctgtccctctagagaaccctgactaatacagtatgtatctatgcatagggaaaaacattgtggatttagggtttggtgctgtccacgatttcaggtatccactgagggtcttggaacacatcctccacagacaaggggggactactatacaaagtgaatggtgggtcagaccttattccaggtggtttacaggtatgacttcatttaatccccacaacaaacctatcaggcatgtgcatttattatgtttctcttctcacaaataaactgtcacaggagaagattattaagttttgaggctctatagcgagtaagtggtaggtgtgagatctgaacacagccaatctgcctccagagagtgggcttttaactgtatactgattcagagcaaacatagacatggtgtccttgaaaaagtaagggctttgggatcagatgaactaacattagaaacctgtacgatactgacactcctcccggtttaagtctccaagtcaacaaaatgaggcctaaacctggcatcaggggattaagtgagataggtttacccagtacctagcacagtgcctggcagggtagtttgataacaatttgcttctttccagggatttctgttaaggaaaatatttgaggactacacaaagttgtatatactgcaggggaggcaaaaccttccctccaccctcgaagggccccagctggacctgagacttaaactaatataaaatagattaacaggagaaaagcattcaaacttcatttaagttttacaggacacaggagcgcttgttagggaaatgaagaccgaaagaggtggcaaaacctaaatgcttttatatttggttgaacaaagagaggtaattgtgggaaaagtaaattatgtggggaggataaagggagataattattttaacgaagttgtttgtacagaattcacttggctttgaatccccattgagtaatgtttctttcctcttggtacagtaaagctatttttcacatgggagtttttatctcctgttttcaggaagaaaagaggaaattcaaatgcccttcttgcatctgctatttttcaagtgcctttagctcaaagtaatccttatgccaaagtggcatattttgggcgggcagcatattctgccatccttcagtagaacgatgagaaagatgttcactgcagcaaaacacatgtacacaagaatcaaaagggctggaaagaaatatatatatcaaggtactattaaagttaatttgcttttaaaaataaaaatcaaccctgattttcttgcttgggagatgaataaaaaatatattttcaatgaagtttaacttcaaagtgacactatgccatagcagctatgcacattcacatgttcaatacattcagtgtgattcgaatatggcatttgtgactttctgttcaggcagtgaagtcacaaagacaagtggttaaaaaagaaaaacattttcaaacactttatgttaatgaccttcatgctttaattactagacccaaaagaaaaaatcaaaagtctttgaggcaaaagctaagctagctaagatttcaagtgcaaagaacaaggaaatgcctactacaaattgctctttagatgtttatagtaattaaatgttttattttgtcttttcgatagcaaatgcctgccaagaaactctaatcatctttattatctactagattctcctcttcattcatggtatttcttgtgaatcagaaaaaggctttaatttttctgacagcaacacagtgctaaaagcaggtgaggacttcttaggaagaaaggcaatgatcaaagcatgcagccaccacatatgagctgttctctgccttttccagtggaagaaagtgggccaatgtgcagcatgtgagcaagggagttgggaggcaaatactattttggtgggtagacagcaggaaaagcaatccagacatcttaatggttgcaataaagtcccttgtgtccacacatttacaacagttatatatattcattcatagcaaagatccctcctgcctaggtcacatggtagactacctaataacactttgtccctcataaatgaatattttgatgaagcagcaacagagttttccttggctggtggaagcgggtggagaggtgagccttgacaagatagtgctttccaagcattgcagccatttggcccagaagcctggtcttagactctcttttcaagaaatgcatcttccagttatccagggccctttacttatgaaaatcattagggcctattaagttataaaattacaaacatccaaggtcttgatagtggtcactaagattctcttcgtttgcttggtttctaatccctttgttctgtatcctttccctttagaaacagcctcttcccacctttaaaagaccttagtatagggctgccttcctttcctgagtgcacaggattcaggccagacacagtgactggttcagaagttcagtcagcatccttccaggacattcagacagattctcgcccctctgagctcacaagctgaggggtgatgtaagcctagccacttgtgcccttgcttctgaaaaacctgcctcagggcgaagccaactcaaaagagatctaagagatgggaaacaatcttaatgctgccatttgaatccctggatgctgagttcaagatcagactcctggagataatgaattactaaagcatctccttttgcttaatctgctttgagttggttcctgtcacttgaaagtgaacaaggtctggctaaatcagtagccaatcctattattcaggggaaaaaagggtagtaagaaatgagactttggagctagggaaggttaaaaccaatgaggagttttgaatataatgagaggtgaattgaaaacaatatgacatttttgttatgtttcttcccagtgttctgtggttggggaatgtgctcatcattttagttggtggcaacaggggtaagggagagacaaattatgaagaactgtacttttccatatggaaagtatatatgggccaggcacagtggctcaggcctgtaatcctagtactttgggaggccggggcaggcagatcacttgaggtcaggagttccagaccagcctggccaacatggcggaaccccatctctactaaaaatacaaaaattagccaggcctggtggcgggtgcctgtagtcccagctactcgggaggctgaggcaggaatcgcttgaacccaagaggcagagcttacagtgagccaagattgtgtcactgcactttagcctgggccacagagcaagactccgtctcaaagaaaaaaaaaaaaaagtacaaatgagctaatcaatctggtgatttacctttgcagaaaggagttttacacaatttggaatataaattaaagcagcggtccccaacctttttggtactagggaccagttttggggaagacaatgtttctatggaaggtgcgggagtgggagggtggtttgaggatccccgcctgcagttctcagtagggctcacatccctatgagaatctaatgctgccgcttatctgacaggaggtggagctcgggcagtaatgctcactcgcctgccactcacctcctgctgtgcggccaggttcctaacaggccacgaactggtactggtccacagcctggggtttgggaacccctgccttaaagcatctcctactctaaagtggctgtgttctccatatttaacccagagcacttccccacttgctataccacgcaagatgacagaaacctcattcttccagactacgctttagcctaaagtagagatatatgcacaggacagaggtatgtccacaaagagagctgacaaagctaatatccagacagggacaatgcgaataggttatgagaaaactgaacacgttgaaatggaaaaaaaataaattagagaaaaaataaaaatattcaaggcagacaagaaagaccccatgtatacataactggtggtcttgagggagataacaaccataaagagagaaacaggtgactgtaggagtcctggggagctgggtttacacaggccccgcctctctgatcccacccccaccccactgcagctccctcccttggactaataaccacagcaagcatgcttccaggactggagggtaatcagaggccatgggttccccaagatctgcagaagagatccagtacagggttcctccctccctgagacacaagtgagagcttagcaatgaagttgcatgcggagaagagggcttgccccttcccaaggaagtcctgggaaaagcaaggactgtgtggtacttgtggggtctgtgctggcagaagcccgtgtctcccttctgagagagtccacagctgtcccctttctgagaatagtcctccaagaccctgtcccaggctgttgttctttgggagaggcaggctaactgctgccaggcttcaaggttgggagagccagcagtttgccccctgtgaggcctgggctccaagaggcccttcatagtacttcaaaaggcatgtagacagtgtgccctctgatgcatcgtgaccataaaagcaaaacctgctgggcctcttgctacttgccacctcatactttttcagtgactcccaacaacatgactcacagaggaaagggagaagcacagaccccattccagttatcccactggatatccttggcctcttttctgcagatctgttgaccacagatgtaagaatttatttctggagcctcaattctaatccattgctctacatgtgcactggtttcctggggctgccacagcagaataccacagacttgggggcttaaacaacaaagtgattcctcacagttctggaggctccaagtctgagatcaaggagtcggcatgtttggttcctcctgaggcttctctccttggcctgcagatgaccacgttctcactgtgttctcagctggcccttctctgtgcatgtacatccctggtgtctcttcctccttttgttgactataaggataccagtcctgttggaccagagccccactgtaaaggcctcattttaacttaatccacttaaataacttatttccacacacagtaagtctgaggttgagtcttttgaattctgggggagacactgcagcccatcacgtatgttgacgtgtgccaccgccacactgcctggttactgcagagtgttagtaagttttgaaattagaaagtataagtgctccagttctgttatttttcaggattattagggctattctgggtcccttccatctccatatgaatttgagaatcagcttgtttattcctgctaaaatttagttgggatttttttttttttgagatggagcctggctgtgtcaccaggctggtgtgcagtggtgcaatctcgcctcactgcaacctccacctcccgggttcaagtgattctcctgcctcagcctcctgagtagctgggactacatgcgcacgccaccacactcagctaatttttgtatttttagtagagacggggtttcaccatgttggccaggatggtcttgatctcttgacctcgtgatccgcccaccttggcctcccaaagtgctgggattacaggcatgagccaccgcgcctggcctcagttgggattttcacagggctcgttttgagtctgcagatcaatttgggtagtactgacatcttaaaattaagtctaccgatccacataagtgggatgctagttaatatggacaagtgaatttattactcctccaaaaaactattttcacaaactttatatcaacatgagaaatcatgttgtatctttctacctggagggagcaagaaagtcaggtggtgtgccttttgtacatgggcaacccaatttcttatctagactttcttttgctcgcctggaaaaaaaaaaatgaggtattgcaaaaatgtgataattgctttccttagtatgaaaaactgttaaaatgagtaaagcctgtgctcaactagaattctcacatttccgttttgatgtatccgcatttcacagtaaaaaaaaccctcagttatgtacatatgtgatcctgaagtacccatgattaaaaacaaatatttcaatctacaatgttcagttctattagatcattaaaagacgtatctctactcgcattctctgaaaacgtgtaaatcatgctcagcatagtgacaactccactaggacaggccgaccaactcatttgttacaaagtctctggccccctgagtgaggagcccccagaaacctaatgtgaaaggaaacttcggttttctccccagctgctttccttgagtttgcatgatatgctttggctgctatgtggagctgtcaaaagccttgaacagacaaaataaagaagaatggcattccaggaaataaacaagcttaatctcagttggacagaaggaggtacaaagaaggcctggggaaggaagaggaagaggcaggatacagggaagacagaatggactctgtaacctcaggaaaaaatagcaaccttataaatacaaagatgttccctggcagacacatgtcagcacctgggttatgaaagaccagccaatgcccccccacacaggttagaatcacattcatcaggaaggaagagagcagaaggaccctgctgcctggtgatgtctcagctggcgtggctgcagctttgcttccagcagccggggaaccgccatgggaaggcgtttcctcaaaatgcatgaaaggcggaggagcttggttttctgatggtttgctgccccttgaagttggcaacaccatcccttcatctgcatggataaaccggggcatcctttttgagaagcagtacttttttttttaagactttattaatcccacacgtttgagagaggtggttgggaaagcaagtattaatgaattaactgcttcctaggattcaatcagtcattaaaaatgtacccgtgaaattttcttgagctgttcaattgtttatcattatccaagtggttcatactctcatgcatttattttccttccacatttacctctaagcaaattacctaattcaacatggttattattctggatatttaaaagctgtgtattgggaaatttcacatagtaatatgaatacacctgttacgcttaatcctttgtgcctaggtgtgattattagatataatttatagaaattctgccgaactcattgtaatttattatccatttatggttttacttgattagtcttacttaaggatgatattttctaaatgtataaataaatgatacagcctattaaagtggaggttatataataagtgacgggtttaggagtggacatgtgaccgagctctggccaatgagttgcaaggggtatttttggaggcatctgagaaatgtttacttgctcttaaaaaagaagattgtaggaaaaaaagaaggaaaactttcctgttctactggacccccataccagacatctgcatgtactgcctcaagcaggggcaactgtctcatgactgagtagagctaagccaccacatcaacacatcgaaactggcagaggggaaagctggaaagattctaggtccttgaatttgtgaggctgctgaaccagctaaccctgcggcaaccccgctctggacttgccatttgacgtaataacttccttcgttattgaaacttgtgtgaattggtttgtatcacttgcagccaaaagccaccccaaagcttcccagctgacatctgtagactagggagtcccaacaagaggaacagacttcacctggtgaagccgtgccaacccactccacctgtctctgagatctatagacatttgaatgtgagcgtgaaatgctgctcaagttcaggtagactacagctcaagaatgtgagactacaggttggtagtctgcctccctctctaaggcaaagagatatttcaatgttacctgggacctgagaaagggggagggtctatggtttgcccagataactaaagtctgtaggttagaaagtcaggatttgtttggaagctataaagatgtatcctcatatgtcatggacatcatgtgatatggtttggctgtgttcccacccaaatctcatcttagctcccataattcccacatgttgtgggagggaccccacgggagataactgaatcatggggaaggtttcccccatactgttctcatgctgatgagtaagtctcacgagatctgatggtttcataaggggaaactcctttcagctggttctcattctctcttgtctgctgccatgtaagacgtgccctttgccttctgccatgactgtggggcctccccagccacgtgaaactgtgagtccattaaacctctttttctttataaattacccagtcttgggtatgtctttatcagcagcacaaaaacagactaatacatcatcctaacttgaatgatgcctgtcctcagtgagtggtccattgtgagtatccatcaaggagttttctcccactgcacactggacctcaggagttaccacaagctccctagcactcttcaaattgttcctcgtttccagcaagtcatctcttctccacccacctcatgaattcaatattttagatgcctgtcacattgcctgtcgctgatccctgactcttgagaccccactatgtgctacagtcttggtcccctgtttgcttggaagaagacaggaagttttaacccgaggctgtagagggcttcaggcataccggtctgttcttgttgcctggactcctccagcacatccaagtctgccctttaaccgtttcttggctacaactggtctcaatatggtgatggccaggggacagatgagctttgaaagcctcgggccaaccagccagatgttctcttgcctccagtggtcactggtgatgcctggtatgggggtgtgtccagaggttgacccactgttgctccccatggcctatgatagagggccatgctcacacagggagctgggaccaaagaccagagtccagcaagaatctctggaccaaaggtcaggcagtctggagacagtctgcatctctggcagaccccagggtgagaagcagctatcccaggccagagtggggtcagctggccaatctgggggctctggagcagatgagagggagcctgtcctgcacacttgaaagagaagttgcaaggtagtaccaaggacaattcagctctacttgattctgaaaagactatccccaccctcaccataaggagaagagacagtgtagtttgccagtgcaactgcggagggaaaacaatcccaccctatctgcctctatctcttcttctttttttttggagacagagtcttgctctgtcacccaggctagagtgcaatggtgtgagcatagctcactgtaaccttgaacttctgggctcaagtgattctcctgtctcagcctttccagtagctgggattacaggcataagccatcatgcctggccccatctctatcaatccaccatggcctgggggggattttagctatcatagcctgcagctgggcccaaaccagcgctggggaaactccacacccaccaaaacaatgcagcacagcaaactcatgtgccccctaagagggacagtggtttgaaggaaggagacagccaaattctagaacagatggctactacagagcagaactaatgacagatacagaaatagactatataatataaacaatgagaattcataaggagatattattagagcacaaaaaatgctgccagaacagaaaaatgcttgattttttttattgttttgttgttcctggatcctaagagaaactccaaatgctcaactttttccatttaaaaatttagtagaggtactgtataaaagaacggtccccactaaaaaccaaattactattttaggaagataaaatgaaagacgtatcccacagcacaagataaaaagttaatgaactaagaatcacgagttaaggatcaagatatggagggtggatgcaggaggatgcatcctatgtaaataataggagttgagggagaaaacaaaagtatgagagaataaaaaaagaaatgccaaagaaacaaaaccaatcgagtcttaagattgaaagggttctgaaaatgctgaatttagacacatccttacaaagctgctgaatttccagaatagggaggaaaatcatataagcttccagacaggaagaacacattgcttttagaaataaccagtctaggggccgggcgcggtggctcatgcctgtaatcccagcactttgggaggctgaggtgggcagatcacttgaggtcaggagttccagaccagcctggccaacatggtgaaacccatctctactaaaaatacaaaaattagtgaggtgtggtggtgcaggcctgtaatcccagctactcaggaggatgaggcaggagaatcgcttgaacccaggaggcagaggttgcagtgagtaaagattgcaccactgcactccagcctgggtgacagagagagactccatctcaaaaaaaaaaaaaaaaaccaaaaataaataaccagtctaatatcacatttctcacctgcaatcatggaaagtaatagatcatgggctaacatttagtggctagggagaagaaagaactgatgaggaatcctccaccaggcaactacagagaaatcaatgattggacctgcagtcaggaaacacagcttctctgcatactctctgtgaatactccaggatacgctaccaaagagccagatcagaacaagggtccaagggagaagacagagtgcagtgatcaacagtgagagtgaatctcgtaatatttatttttaaatcttcatgcacaatggtaacgtcaatgcaagttataacacaatttttcttgaggattcttgaaatgaaataatgaaaattttagttagatcctagccccaatctcagcatactccaggaataaggagaagacaagggcgaaggagtgaaaagaaacatgattcccagggtttctcctccaggtgggatgagatgaagaggacactgaaaatattcaggcagaagggtgtgctggtaattaagctacgttttctcaatttcaaatccactgctccctgacgctggagtgggggctctttaagctgtggttttcttttgttagatggtgttctattgggttcttccagtaagaggcaatggagggagcctgaaaagtggggagaggagatgaacttgcttcttccttttctcttgctctccatgtcagtaccagcctggcagtacccctgccctgggcttcaacctctctcaggacttccaaaccagctttcttgtgctctctcagaagtatgaacaatagcaaagcacttccctgcagatatgaaaaagactgaaagagaatactatatacagcctttcccaaaacatttgaaaaacagagaaagtgggcaaattcctagaaaaacacaaccaagaaaaactgatgcaagaagaatcacaaagtttgaataattctaggagcttctgaatctggaattccaaacttcccttcccagaaaacttcaggccaagatgacttcactagtaaattccactgaacatttgaagaagaaataacaccagccttaaataaatgtttccagaaaagcaaaagagggactaatccccattgtgtcttatgaaggaagtttaacctccatataaaatctgtcaaggacattttgaaaaatgaagatgaaagaccaatctctctcatgaatatacgataaaaaaatcccaaacaaaacattaacaaacagaatcaagagattcagcttgagcaagctgagttcagtcaaggaaataaggttggttcaacattcaaaaaccaatcaagataattcaccatattaacagaataagggagttctctcatatggtcttcccccaaaaaagaaaagtcatatgataaaattcagcatttattcatgattttttttaaactaacaaaacaaaatttagcaggctagaaatagaaaggaacttaaacaatcactacaacaacttccattaaacatcatatgtaaaataatgagaatgttgcctcaaagataagaaataacaaagaaagctgccatcatcacttcatcattttactggaagtctcagtcagtgcaatcagaaaaaagaaataaaagttacaagattggggaaaaaccccaagttatcttattttcaaatgatgtgattctacatgcagaaaattcaaaagaatgtaaagataagttaatagactcactgaatttatcaaagtagctcgatataaggttaatagacatacatcagctttatttctattttccaataacaaaatagaatgaaaataacagcatatgtggtacattttcccaaagatggatgcaacgcaatctcccccctacatgcccttttgtaccaaaatgtgggtggctgaaccttccatcaagggacagggactatctgtccaccctctcaaatgtgaactccttttgtggcctgctttgaacaatggaatgcggcggtagtgacactgtctgagtcctggagccccggcctcggaggctgacacctctacttctgtcctctggccacggtccccactgtagtgctctccttgcacggacagagctcagcccatgccactgactagggatgacaggaaaggctcagcagccagcatcaaagttccaaatagaagagtgaggccgtttagaccattatgtaattgagtgtcctgtttttaaaaagtatttcttctttctccttcctgcctgttccttgtcttgcccttagcatgagataatagtctttgctctccctccttctaccaggaactccctggcacaatgtttccctcatctaattatgtttttgtttagaagttccagagactaaatcttgaaacaattcgggccactatgggattctccctgacctgcagattacttccaagctgcagttaatttgcaactgggctgtacccaagatggcaccagcccattcaccagatggggcaataacgcaagatagtcataggaacaagtcatgtagactggcacctcctcatcactcctgcatgcccctcataccaaacaccctttttaagcccttaaccttgacccaaaaagctgaaatggtttctttcaggcactatccgcggccatttccccatggaatggggaagaaagcttttgggataaagtcactttcctttcactgtattgcatccttgttctcggctttgcaagcagcaaatagccgtgcctgcattcggttacaattggattgctccagctacactgcaatcacagaagaaagtttaggcaagaccagcaaaaaaaaaaaaaagaaaaaaaaaaaaagaaaacccatggaatcctgaggaatgataaaactattgttgttttaagccattaccttttgaggtggcttgtggcacagcaatagataaccaaaacaccatactcaatcacaataccacacacacatttattttgtttaaagtagaaatatatctaatgagagatatgcagtgcctctactcagaacattataaaacaatattgagataaattacgtgagacccaaatacatgttcatagcagacatgctacggtaaagatatcaatattccccatattcatcaaaagcttcaatataatcccattaaaaattccagcagggtttctttatacaatttgaccaatttactaaaaagctcatgtgaaaatgcaaatggccctgaatagcaaaacaagtctgaacaacaaaatgctgatgttatagataccaagtcttatttataaatctatagttattaagacaatctggtattaatgcaagtatagacaaaaagaccaacaagatcgaacagagaatccagaaagtgacccacggttaggaggacactcattcgtcacagagatggcactgcacagctgtggggaagggactgtcttttgaataaatagcccaggatcaattggatattcatacagaaaaatgaaattacattttttaaacaaaaatttactttcggtaaactgtagttctaaatataggtgggaaaataaagctatttgatgataacaggagaaaaactctgtgaccctgaggtaggaaaaatattttttaaatcaagacaccaaaaagaccactgaaaaggcaagcctctgaaagcaagaaacacatactgttctgtatgcatatttgtatacgtgcgtgtgtgcatatacagtcatgtgccacacaatgctgttttaggcaagtctgggccacgtatgtcacagtggtctcgtttgactgtaacgcccagcacagtgctcctgctcctgtttccccatcatcaccaacacctggtgttgtcagggcctctacactggctgttctctctgcctggaaagttcttcccacatggctcactcccttgcctccttcaggtccccagcaatggtgagatcttccctcataactctatattaagtgtagtaattaacggtacaatatttctactgtaccttttctgtgtttaggtatgtttagaagcacatatgctcaccactgtgttacagtcacctatagtattcagcacagtaacgtgctgtacaggtttatggtccaggagcaatgggctgtaccctatagcctataggtgtgtagtaagctgtaccctcatctaggcttgagtaagtactctctatgatgtctacacaacatgcatttcccagaacacctttgtcattaagcacataacacataactatatatgtacatgtgtatgtatgtacatacatatatgtatatatccgcccaacaaatcacaaataactcaatgacgggatcatttccagaacatacaaaataaataagaaaaatgggcggggtgcagaggctcacgcctgtaattccagaactttggaaggctgtgggcagattgcttaagctcaggagttagagaccagcctgggcaacgtggcaaaaccctgtctctacaaaaaattagaagaaattagctgggtgtggtggtgtatgcctgcagtcccagctactctgaaggctgaggtgggaggattgcttgagcctaggaggcagaggttgcagcgagccaagatcacgccactgcactccagcctgggtgacagagggagaccctgtctcaaaaaaaaaaaaaagaaaaagaaaagaaaaatgcacataacacaatggaacataagggcttcaagaaaaagagcatctaaatgtcaagtaagcatgaaaaggcactctaccttattagcaatcaaggagatgcagaacaaaactgtaatgagacaccatgactcaccaccctatggctaagatgaaaatgactgacaacatcaagtgcgggtgataatggggaaaaacaggaacattggtggggtaatgtaagctggaccaaccactgtggaaaatgatctggcattatctactaaagttgaacctatgcaccccgaaatttcactcctagagagtgcacaaaaagatttgatatgaggcacggtgtggtggctcacgtctgtaatcccagcactttgggaggccgaggtgggtggatcacctggggtcaggagtttgagaccagcctgatcaacatggcaaaaccccatctctactaaaaatacaaaaattagccaggcatggtggtgcgcacctgtaaacccagctactcaggaggctgaggcaggagaatcactggaatccgggaggtggaggtttcagtgagccaagatcgcaccactgcactccagcctgggtgacagagtgagactccatctcaaaaaatatatatatacatatataagtgaaagttcacagcagcattatttgtaatagtcaccaaattgaaataatctaaatgtccatcaacaacaaaatgcataaataaaatgcaggatgtatacgacgaaacactgtacagcaataagaaggaggaactacggctaaatgcggcaacatgaatggatctcattccttcactgcttttgtggatctggccctggcctcccagggcacaggtaccagagggaccctcctgcaagtccctcctcacctcaccaccacaatggtcctcaaaaaagtcaaactctttaaaatcccccaccagtctgcacaccgggcagcccctgttgtctagcctcacctcctactttccctgagggcactctcccgagccataacttctcctcgcagtctgttccttgagtgtgccaggcgtgcttccacctcagggctctgcacgggttgtcctctctgcctggaaagttcttcccctgcagaatcacgcggctcactcccttgcctcctgcaggtcttggggaccatgagccctttcccatgactctatattcaggtatcaccccatgtccatactcccgaggttttgaacgagttttactttttcaccataacactcacctgcatctggtatatgatttatctgcccattctgtatgatcaatctccctgcacaagaatgcagctttgggagaatgagaattttgcctcttttgttcactgttatatccgtaggagccagagctcttctaacacacagaaggcgctcagtacaattctgttaaaagaatggccacataagaagacagaaacacaaatgctgactgatgctgtctgtgcttagacagagcttgtctatccgtgggcctcaccagtaggttcctctgcctgtgatttcctttctctaggccgtgaacttctatagaaaggactcttgcagctcctgccagggcattgttgagactagcagccagcactgtgggagccaaagggagtgaagctgaggaggccgatggagatgcggcctcatctcttcaaaggctctcacttaatcccaagtgacttaatcccagtgttcacagaacatccatgtgcccccctgcagttcctgcctcccttgcagctgggatgggccatgtgcctgagtctggtgaatggacatgtgagtagaaggggtgtgtcccctctggcctgaggtgctcaccatcaggtgcctcccccatccctttcttccccctagacagcaattctgggggccatggaaggggtctcattacctcccttcccacacagaggaaagctgccctgaagagctatccagtccatactatgcatttgtgactaagaaacaaacctttgctacgttaagccattgaaatttcaagggtttttttgttactgcagcatagactatctcatcctgacgatcttctgtcaggcacccccactcctgccttagctgtactagacatccttgtactctgatgtctctctggttcaacctctgtctgctactggggtcagatggacagttacaaagctgcacaggctccatttggggctctgagggggttgcctgcatatcacagactgtaaaccagtgctccttttgccccatccacattcctgccttcagagacatctggtgactctaattcctgagcccttgcagggccctgaggcacaaatcagcttgtttcttcctgccccaccctggacccccagctctcagcatggtggataagcagaaagaaatcgaagccaaccacacaatgatacacttctcgtgcttccaaaatgctgctgacattttccatctgttcatctcctctttgtgagtttgaatcttttttcttttattcttttattgtcattttaatggtgcttcaggagaaatagtgataaacaataactatttcgtgaatacctatttattttgaatattcattgtaaccactgctaagaacagcaaaacttttaggtttgcataggttttttttttcttccaagaagttcagagtacatttaaaatatcagttcaaagaacaaaaggaaaatattattattaccattttaaatcagataaagccctgtgaggtctgaaaaactgccccaccacccaatgtttgccaatgctgggacacaatccaggctcccatctcatgatctgattttctactagtggacactatcctgagtgctatcatttatatccatcttcccacctttcataggaattctatctgcataacccaaagaatacctgctggagactgacacttactgcaactttgccagcactttcatgttcttaacaaggcatttcaccagtttaactactgatcatcactgacaggcttcagtacataatttcatatatgaatcttcatccatctttttcttttcttttctttctctcttcctttctttccttctttttctctttcttcagtacataatttcatatatgaatctccttccttctttccttccttccttccttctttctttctttccttctttctttcttgtttttcatggagttttgctcttgttgcccaggatggagtacaatggcacggtcttagctcactgcaacctctgcctcctgggttcaggcaattctcctgcctcagcctcccgagtagctaggattacaggcacgtgccactacgcatggctaatttttgtatttttagtagagatggggtttcaccatgttgtccaggctggtcttgaactcctgacctcaggtgatctgccctgctcggcctcccaaagtgctgggattacaagcatgagccactgcgcccagcaatgcgttttcatatattccataaaacacagaagtgtgtactaagatcatgtatatgtatatggcttggaaaatttataaggtctccatctagaagctgtacatctttggttttaaaaggagagggctagagagaggataaatccaatcagttgcttctttcattcctcacttcttttctactgttaacatacgtggtcataaagaataccagatgcaggccaaatacatttgccatgagaaaaagataaaaatcaaaacttatggcttctcaatactgcttagtattaaagcacaatgctgcattctctactacagctgtgtagttacaagaatctatttgagtggccatgtgtcaaagataatggcacaaaaaggctgggtctatatggctcatggcccaacatccactgcttaacatgatgctttttctggattaagatcttcaagtcaggcaaaggctccggaggaggacagaaaaccaaagtgaagagatgcactaggtagggaggtttttgggttgtaagtgatagaaactcaactcccgttacctcaaacaaaaaggggaatttattgactctttttttttttgagacggagtctcgctctgtccccaggctggagtgcagtggcacaatctcggctcactgcaagctccacctcctgggttcacgccattctccctcagcctcctgagtagctgggactacaggcgcccgccaccatgcctggctaattttttgtattttttttttttttagtagagacagggtttcaccgttttagccaggatggtctcgatctcctgaccttgtgatccgcccgccttggcctcccaaagtgctgggattacaggcatgagccaccgcgcccggccaaatttattgactcttagaaccaggaagggttcccccaggtcccaggcagagagtggggatgcaagcaggcccagaagcaggtgtgagctgctgtgggcatcgctctgtccaggccgtcccctctgtccttggcttggctctaatcctgcagcatggcttacttcacactcggggaagcgtggaagttggccatgctgagcaactctcttaatggagagatggagtgtggggtccacaccctccacccccgctccactgcctgcacaccatgccaagtccaggtattctagggaatggaattctttggggttcgctgccatgcccaagacagtgccttcatgctgtcctcacagcgcatcctgcagtaactgtggggaaactgagggtggggggagattgtctgggaagaggagctgggcctacaattctgatgctccctgcagcctaacctccaccccccatgtcactgccaaggaatcttgcagcccagagcagacagcaagagcctctgcccactaggtctggtgctcagaagcaaagagggccctctggggggacagtcaacacaaggagacttagggtgggtatgggcagccagagccccagccccaggagctgggattagggcccaggaatgaggaaacagggaggggaaagcacattgaccaatcctggaagcagcgttattgaaaggttctggaaattcaaagaagcaggcaatgtgtgggcagactcccgttagtggccagagcccagaaggaaccaactttgccttcaacctcagcccactccctgctaacagagggagatggtgacgagtctgaggggcagaaggaggtccaggcatagaattgcacttgtcctgggtctctgcaggtcagcagtgggatgagtagggagacagcccgccctgggcctccacagtggggaaatgaggcaaacgtgtctcttttgctacaggaccaagtccactgtcctagaaaggtttagttgacaaaaaaggagacattcacacatttcctccagcagacccactcactgttatttgttacctgggaaaccaaacagccatatataaacaagggtaaatcttagaatcttggaaatgaaagtgccataatttccaggatgatattaaaacgccgtgactttctgaaaagggttccagcaacgtggttgacagaaaatattgtgctttcttttccacaaggagattgaatgtgtcttatttacagttacccagaaaacaatgatgaaagtagctaagtctgcattctagaggcacaggtcaaggtgtctgaggaacaatttggcatcttggaaagtgaagtcccgaggctgggaccctgtggggagccttcttcattgcaggctccaagccgccagtctcctgctgtagggagaaggctgtcggtgctgcaaggatggagggggatgtgcagagcccaggcactgagagaagcttcttagagccagaccatcgggagggagaaaacagggtgacaggggtcagttcatgaagacccttggattggatttcattccaagaacagtgaaaaacccatgtaaatcaggacttcgtgaatgtgcttattctaacttccagaggaaataatgaatgaactgtctactgaaaacccctgcctgtgctccatctgaaatgctgcctccctcaaagcatgaagctggagtcagcactgacgacgatgggcagctggagtgggagaagaggagtggcatggcctcagggagggccaggtccccctgcacctctttcccacttggtgtcccccacctggtcactcccaggaagccactgctgaattgacagccaggcctctactgagtcaagggcgacatctggagatgtagaatcagacataaaactcagcacagtactcatcccttatccttagggggatacatcctaagacccccagtggatacgtgaaactgcagatggtaccaaaccctacgcagcagtttttcctatacttacatacatatgatacagtttataaattaagcaaataagagaataacaatagctattgataaaacagaacaattataacaatatgccagtaaaactactcttgtgttttgccaccattaagtaatatgagggttccttgaacggaagcactgcgatgtatgtctgataaccatcctggctactaagtgacggccacgtggggagtgtggacagcctggagacgctggacaaagggatgaagaaagacagcaggagatttttatcctgcgactcagaacagtggatttaaaacttgtgagttgtctgtttctggaatattccatttagtatttgcagcccatggttgatcaaaggtaacagaaactgtggaaagtgaaaccttggggaagaggggactgctgtataaaaaactttgaaaccttttccatatgtgtgtgggctccatccaatcacgtgaaggcctcaagggaacaagactgacctcccctgagcaaggaggaattctgccagcagaagggctttggatcgaactgtaactcttccctgggtctccagtctgctggcctaccctgcaggtttccacaacaccatgagccaattcctgaaaacaatctctctctatgtatatatacacatcctgctgattctatttctctagagaatcccaattaatagaaacagtaatgtagaaaagagatgatggtggcttggatgagggggtagcagtggaggtgatgagaaatagttacattcagggtgatttgtaggatttcctgaaagtttggattataggattgagagaaacagaagggctaagaatgaatctacagaagggcaaatgtaagatgctatagaaggcagaattagacctattttaaaaaacacatgaaatcctcagaacaaatattggaaaaagagatcctttaaaaaattgttacaaaactacaaaataactaggcccaaaatcgacagaaaatattatgaacctaaagcaaagtaaaaactctgaaactctacagaaaatcataaaacttgatgttttttaaattaaacattacatatattgaatactataaagatgtcagttctactaaaataacatataaatccagtaatcctagttacagtaacaactggattgggatatgtattagttttctagggctgctgtaatcaagtaccacaaattgggtggtttaaaacaacagagcatccatcagggagagaattggtcaaatcagagctttctagaaaggccatcccttaagagcaggtctatctcagctctagagtaagggttactctaggccattggttggcaaactgtagcacatgggtcaaatgtggcctattgccctgttatcatatagcctgtgaactaagaatgacttttacattttaatgaagaaatatatgtcacagaccatctgtgacccataaaccctggtcctttacagtaagtttaccaacccctgctggaaacctaccataaaaaatcttaaaaacaaactcaaaagcaccaagctaatccacaaataaatgaactaactacctgccagaacaaaattcaacactctctgaagcgaacaaaatctaaaatccagacactcagccgtatcacatttacaatgtccagcatacgctcaaaacttaatagatgaattcactagagaataagtttcagacaaccaaaatgaccaaagagacactgacaaaagacatatggaaagctcacactggccaaacttagaacagtgtacgcatcatagggaataataattgcagggagtaaaacatgtctatgaagttcataatgatctttacaaaaacaccatttggccacttctagaggatgctcaaaaaccaatgtattctcctgatgacagataaagggaaataacaaagcacagtagataactagtaccatctctatatcaaataatcaaactaataaatgatgaggaaattgtagaattagaatatcatcagtttgcaaccttcagtgtattaatgaatccaggcatcacacattaaaagttgctaaaatcacagagaacaccagactttggcatgcctctttatgaatgaacagaatcccacctatcatcttaccaaagagaaagaactggagtctgatcaggcctctaaatcctgttgcttattaacaggaaatatacagaacacaggaacattttgaactgcagcaaaagtaggtaatcagtgaatccatgcggggtctacaggtgaaatgcttcggctcttgaacagctagactataaggaaaaatgacccattaagataaaaggagacaaaaagactttaaaaaaatccaacaaaacaaaactaaactgcagtgtctgaaggatgcacatttagtgttgaaacaataaaagaatctagcagctgaatgcacatggtttttaaacttgtggaacatggacaaaaattgaccacacatggggcagaaaagcaagcttcaacaaatgtcaaaagtttgaaacagaaaatgtatggtttctgacaaccgtataattaagctaggactatataacaaaaagatactagaaaacctatgttcacaaattaatatccttctaagtaacctatgaatcaaagaagaaataatcaatattagaaaataatttgaacggaatgatattaaaactaataggatacaagtcaagctgtgtttagagggaatttatagccctgagagcatttattagagaagtaaagctgaaaattaatgacctaagcattcatctcaagaatttagaaaaagaactgcaaattaaatcttcagaaaagagaaaaaaaaggaataataaagacagaaagcaatgaaataaaatttcaaaatacaataaaaagggaaaaacaattcattgataattaataaaactggcaaatctgaggtaagattgatgaagaaagcaaactgcaggcatagataactactatcagaaatggaaaggaggtatcacttctcctacaggcattagaaagctaataagaggatattatcaacaaatttataggaatacatttgaaaatttagataaaatggaggattgcttagaaaaatacaacccaccaaaactgacacaagaagaagaaatactgaatttgaatatattgtaactattaaagaaactgaatcataattcagcaccttccatgaaataaaatcctacagccagatgacttcaacagtgaattaattctaatgaccatttaaggaagagatactaccagtcttacatgaactcttccagaaaatagaaaaagaactattcactgtgttttctaaaggcagcataatcttagtaccaacctctgataagacctttcatgaaggaaaatgatatgaaccatctctctcatgaacataaatgcaaagatcctaaacaaaactttaacaaacgtgacttgaaagtgaaaaaaagaaaaaagaagagtaatgtccatggaaataaactagaagtacataaaaatgataacacaccatgaccacataaggttggatccaggaagcttggtctatccataacaggttgaagaaatattttatgattatgtgacagatgaagaaaattacagaactgtgttcaacaagtattcatgttaaaaaaactcttagcatacttggtttaggagttttggctacagcttactggtgtttaacaaactccttcggcctcagcagctgaaaaccactttcctatggtcatgaggtctgtgggtcaggaattctccaggcacagtggagatggcttgtgtctgctccatgatgtctgggcctctgctggaaagacgcagtggtggagatgaactgctgcctcttcagcgtcaccttttacctaccactcagccccaggtcacgtggctgcagcacactggcttcttgactgttccttcaactcaccagccaggctccagcatcacagaccttacttgctcttccttctgtctggggccttcttaactagacatccacctggctggacattcttctttctcaagtcacttctcagtgggatttctctggcctccctatgaaaaatcaaaatccccatcctgtgcccactgaccctctctggccccctttctgcctgtaattatcactttataatatataatatagttaacttatttaactatacttttattctatgtcttccctcatgaggatgtaagcttcatgaggcaggtatattttgtctaattttattcattgctgtatccccagagcctagtatataataaagcacacaaacattagctgttgattaaatggatgggtaggtagatggatgagtaggtgggggatggatggatggatgaatggatgggtggatgggtaggtgaatggatgagtaggtgggtgggtgggtagatggatgggtgggtggatgaatggatggatggatggctaggtgggtgggtggatggatggatgtgtggatggatgtatgggtgaatgggtagatagatggatagatgaatgggtaggtgggtggacagatggatgggtaaatgaatggatgggtgggtgagtggataaatggatgaatgggtaggtgagtaaatggatggataatggatggatggatggatggatggatggatggatggatgggtaggtaggtgggtgggtgggtgtacagatggataagtggatggagaaatggatggatggatggatggacggatgaatgggtagacagatgaatcggtaggtgggtagatggatggatggatggatggatggatggatggatgatggatggatgggtgggagggtgggtaaatgcatggatggatggatggatagatagatggataaatggatggatggatggatggatggatggatggatgagtggatgggatggatggatgttgaggcatggcatcaccaatggtagataatcactgggttaaaatggaatatatgttgctattaggaagaatgaattaaaactctatgtgttgttatgaacaattaccaagatttattatgagaaggaagcgaggtacagaacatagtcttttttttcttttgagatggagtctcgctctgtcagccaggccggagtgcagtggtgcgatctcggctcactgcaacctccacctcccgggttcacaccattctcctgcctcagcctcccgagtagctgggactacaggcacctgccaccatgcccggctaattttttgtatttttagtagagacggggtttcaccatgttagccagacagtctcgatctcttgacctcgtgatctgcctgcctgggcctcccaaagtgctgggattacaggcatgagccactgtgcccgaacagaacatagtcttaatatgctccttttatttccatttaaaaaataatttctatacaggtaaatatgtgtggatatgcatcatcagtgttttctgaaagaagtaaaaaacactattcataatggaagttctagggagaaggactgaaatacaggtgggaaggatgccttacttttccatttagcacttttctgcaaagtttggattttctaaccatgctactcatatttttattttaaaatatcaacaggagttttttgacagtatgatcatggactatttaaaacagtttttctttacaattcttgctacctaaaataatacttgttataaaataaaaaataagggtaattttatttaacagaatcgagaaaagcaatgctagtttttaaggacttccttgaatcactgagaggtcttcttttgtcacataaggattagataatgttcaatattttctatctgctaaggcagaagtacttttacttatgcatgtccttagagttttcagtaacaaaaatttcagataatcagagcactttgttctctacaccgtctgcttttctgtgattttacggtaataggcagtataacagagttgacagaaaaacacttagtaaataaatatggtttaaaactttttatactaagttttatgtctgattctgtgtctccagatactacctttgactaaggagaggcatggttgtacgttcaatgatggctccctgggaatgacccaatggaagtagcattttggaaaccctggttctgtaatctgaacgttgtggcccatgagattaacatatagaaacctaattcccagtgtgatagtattaagaggtgaggtctttggaaagtgattaaatcatgagggcgtaaccttaatgaatggaattagtgtccttataaaagaggctccagagaacttcccagccccttccaccatgtgaggacacagcgaggaggtaccatctatgaagcagaaggtgagcccttgccagacaccaaatctgcttgtgccttcatgttggacttctaaccctcctgaactgtgagcaataaatgtctatggtttgtaagttacccagcctatggtattttgttatagcagcctgaacaaactaagacacccggggtctttgtttgttaactatgcatattgaagctctaaacccatgcccatttccctgtttttttcatttttgatgtttgctcagtttgtggcccattttcactcttcatcttcatattgcaaatatctgatatgacagtcgagtggaagcttctcttccaataagaccatgtaacaaaaatggaaaaccaaaactattctgaaaaaagccatttaaaaaatgcataccaagattttaaaaaaattcctgttaaatttatcatgagtccaagctgttcattcaacttatcgtcttggtatttgatacaaaaaatccccattcactgactttttaaaaagtagaatgatgctggtgagttaaggaggtatagagtcccatgttttaaaggaagatgcagctcactcacactgcagcaatatcctttgccggctgaagcaaaataaaaatcagttctactgaaagttgataaagtttaagtccattaacagcgagagtactttatattagatttgcaaatgaatgagaaattaatggagaaaagagctctcacaatagcttcaaaatgggcatatttataaccctattctgcttgccaaaaataattacatcccatttttttctgccaaccatttaaactcatttcatagaaaacggaaaaagagggttggtgcaaatgggatgtttcccgcaagaaagaagaacggttttggaacccttgagcaatttgcaaggcgtgtcaattttggaacgctctgtcttgaaatattcgctttttttatgtttatttgtttacctattgtttattctccaaatcaattacacaacatttatttccaaatgccacaataatggaagactggcatcacatttggaattgattctaatgctgcacagccgcctgctgaggatcctgatccggttcatgagctgaggctgatcccagcgaccccagacctgaccaactctgcattacccagggaggagcaggccagtctgagcagactcaaaggggccgcttctactcggagccactttgcatccactccaccctaagcttctaagatacttcggagcccacacgacactccttcacaggggctgggtggcctggcctgccacttgaaatatggggctgctggcacctgctgtatccttctcagccccaggcatagctgctgaaaaggtgacaggaagagtctattttcatgtcatcacttagtttgtatttgtttgcagctatttcagccttttacatttgtattatgcattctgaacaagttgctatttgttttcttagttgatgtagtcagctgcacagaaatgcttaatgcttttctcagatgattccaaccaaactgactttgatttcagacagatagcccatggccatgctgacacataaaaccaaccatgacactgggttttttttcagccttttattttttttttaggtttagggacacatgttataggggtactttttttaggtttaggggtacactgtcatagagctaaatggcatgttgttgggggttgttgtgcaggttattttgtcacccaggtgattaagcacagtacccgacaggtagtgttttgatcctaacccccctcccccaccctccaccctgaagtaggccccagtgtctattactcccttctttgtgtccatgtgtacccaatgtttagctcccatttataagtgagaacatgtggtatttggttttctgttcttgcattaatttgcttaggataatggcctccagttccatctatgttgctgcaaaggacatgatctcattctttcttacggctgcatagtattccatggtttatatgtaccacattttctttcttttttctttatttttgagatggagtctcactctgtcacccaggccggaatgcagtggcgtgatctcggctcactgcaacctccacctcccaggttcaggcgattctcttgcctcagcctcccaagtagctgggactacagacagctgccaccatgccctgctaatttttgtgtatttttagtagagatggggtttcaccatgttggctaggctcatcttgaacctctgacctcgggtgatctgcctgctttggcctcccaaagtgctgggattacaggtgtgagccaccgcacccggctgtatggcattttctttatcaacactccactgaaaatattgaacagatcatcgaggcagaaaactaacaaagatatttgggacctgaacttgacacctgaccaaatggacctaacagacatctacagaactctccacccaaaattaagagaatgtacattcttctcatctgcacatggcacatactctaaaactgaccacacaatcagccatgaaacaattctcaacaaatgcaaaaaaactgaaatcatagccaccacactatcagaccacagtgcaataaaaatagaaattaacactaagaaaatcactcaaaaccatacgactacatggcaaacaaccatgacactgttacagccatcttacctgttccctccttcaagacctcccttgcagcctgctctcaactcaccaaccagagtgggcctttaaaaaattaagccaggcaatgacactctctgcttaacacctcccagtggctccctacagcacacagagtaaaaggcagaggacttagattgacttacaaggccctgcagtttccttccctctcccttcctctatgatcccctctctttcctccccactgctcacttccctctagccacagggcctcctggttgctcttagaactgtcagtcccactcagggcctccgtactgactattccctctgcctcagacattgcaaggcaaactccttcacctcctcactccctcacttggctcaagagtcacatgctcaatcagctctgctgtcaccatcctatttacaatgatagtttctgcccccatcactccctcagccaactgtaccacgttctactttctaacagacgttaccatttttagtctattactatatgccttcattaggatgtgagctccatgagggctgagatcttggtctgatttgttccctgatctatctcaaatcctcaaaacagtgttaatagttgaaaagcactcaataaatattggttgaatgaacaaataaagggcttatcaaatgcaaagataaatttttcatttaaattctctgccagaatttctggttccagaagatgggcagaggacaagtcatactggagcttgcacggcacaatgagttcagaagactattctgagtgagactggaagacaaatgagaattttgaactggggagtgacatgaggtgacttacaggtttttaaaagttcatcatggcttctgtgtggtgcacaggattcaaaggcaggagtagcgccagggagagtatttcagctgccttggtccagcaagagattaaagtggttcagaccagagaagctgtgctggaggtgatgagaagtggctggaccctggatatactacgaaggcagagctaacaggtcttgttgatgcactttgctgagagggagaggaagagagggagtggcgagagtcaagggtaactgttgaagttttggcctcagaaactgagtaaatggcagtatccattactgggacagaacagaggggagaagaacagacttgggagtggaatcaagaattctgctttggatgtgttaaaatggaaatgcctaccagacatccatatggaggtgctgactggccagttggatacatgagtctggagcccaaaaaagaagctgaactaaagatagtttttaaagccatgggtctggttgaaatcccattagagagagaagctggatagagaggaagactcggggcttcgtgctgaagcacttcccctttaggaagaaaagccagcaagaggggctaaagaagcagccagtgaggtagggaagggctgagcagctctaccgaactggaagccacatggagcatgtgtttcaaatgttgctgtggggtcaggtgagaagagtctaatcactgactgcgggatttggccatatgagggccttggggccccaggcagcgctgcgataccccagtgggttgttggtgatccttcaggatgggaagcagtgcccactggggcaagtagggtggtacaggctgactgtgggaggcgcagggctcagggaaacctgagcattcagcatagacaggaacctggagtcaggatgacaaggaaaatctcctgaattgggcacaaggatccttgggggggatgaggaagaggaattgagcatgctgcatttcctaaatgtggggcattggggtgcaaggcggtgcacctgaatatgaaaggaaatagccatcctataattccagaagcttgaagacaccaagagagttacactcacagagaagaaaaaggtttgcttttctcatggaaaaggttatatgtaacaagtttaggataccacatgacaatgtcttagttttaattaacttttataattcagcacatttttaaaagcacatacttgtatttctgataatgctatgccaggtttttacacttgtttcatattttttctcaagaggaagttatagtagtgtatctaagatatactgaaaaataattggtaattttttttttttttttttttttttttttttttttttttttttggagatagagtcttgctctgccacccaggctgcagtgcagtggtgtgatcacccaggctggagtgcagtggcgtgattacccaggctggagtgcagtggcgcgatctcagctcactgcaacttccgcctacctggttcaagtggttctccaacctcagcctcctgagtagctgggactacaggcgcatgccaccatgcctgactaattttttgtacattttagtagagacagggtttcgccatgttgcccaggctggtctcaatctcctgagatcaggcaatccaccctcctcggcctcccaaaatgctgggattacaggagtgagccactgcacccagctggcaaatattcttttttatttttaagttcatttgccaagaactcaattatttatagtggtacttctctctagctttctgtaactaaatgagaacattaatttcaaatgtatctctctactaaaatcatacagggtgttctatccttccttttatacaaaaaaaattgacaattatctgacgaaataggaaaatttgaacagccatgttttaaaagctgatcatgtcatgcttcagctaacataaaaaaaaaaaacctgaagtcaaaataaacgtttaaataacctgaacatgctgataattgacattgctttctatcataatcatcactttaacactgaaagatgaagaacttgctagtggtttaaggtagatcaggcattggatacagatccttcccattggtgtttactatccaactgcaagagatattggatgaaatatgaacatagcaaaacatttaaaaaggagaaattagatttagagaaaaaactaacttacctattgctatggactaaagtgtgccctctccattcatatgttgaagccttaaccaccaatgtgactatatttagagatagggtctttagtaggtacttcaggctaactaagatcacaagggtagggtcctgacccacaaggattggtggccttagaaaagaagaaagagacagagacctctctctctctacctgcacacacatggagaaaaggctatgtaaagacacagtgggaaggcggccgtctgcaagacaggaagcaagtcctcacgagaaccagaccatgctgccactttaatcttggactttccagcctccagaactgagaaaaactaaatttttgtgtttaatccacccagtttacattattttgttatgacaccccaagatgactaaaatacctattaatgagtttttaaaaaattattttagaagagaaacaatatgttgggttgtaatgtcaacaaataagtaataatgtgtttatatatttctatgatttttctgagagagaaaaattttaaattgagtaaatttctccccctaggatgcctgtctacagattacttcttccataaactctgacctcaacaattactcctaacaggaattcgaactgtcttgatgcttgaccagcctggccaacacagtgaaaccccgtctctactaaaaatacaaaaattagccgggtgtggtggctcacgcctgtaatctcagctaatcagcaggctgaggcaggagaattgcttaagccagggaggtggaggttgcagcaagtggagatcatgccactgcactccagcctggctgacagagactctgtctgaaaaaaaagaaaaaaggaaagcgtggtgacttgttttagacactttcactactgataatgacagttcacaggaccaggcaaagcagagactcggcacagtgccacagggagaccctgtcctgggcgccgagtggacctgcccctgagtcagctgcctccccttaccagcggtgcggccctagcgctcactgcatttcctcccacccctagtttcttcctcagcaacacagggataggagctcccttgcaggtgactggaggcagtgaatggtccacatatataaagcagctgcagtggtaccttgcacataacaggaattatttttagaatgacgttgaagatgttcagaatacccaaccccaacatatggagctctggcatactgttttcagttaaagacccttgaaaaacagcagaggcaagaaggacattctaatcaccccttttcttcctgaaaataggagataaacattgccatgtgaaagatgtcctccctcaccaggagaatgaaacattcttcgatggggaggaagagccaagagaccctgtgaaatgattcttactccttcagcctccccacacagtgtacctgtccccagctgcctctctttgtccatcttggtataaaagcatttgtgttttgctacttctctgggtcttcatttccttatgagggctcctgagtcacataaaacatatataaattggtgtgctttttcctattaatctgtcttgtgtcaatttaattcacaggcccagctgaaaaccctaggagattagaggtgaaattctgtctcccctataattgaatgtattataacacaaaaatatactcagaaagaagtcattaatttgagtatagtgataatgatagctatcagagtaatcccttttaaaatagtttcagttcctgtaataccaaggcccactcacatgttgtagtattgttaccactgtcgcggtaattagtttccatgacacaaaatcacctcacttgctttcccacagaggcagcaatatgctaaaagagcagactctagaccaggtctcccggggtccaagtcaagtgtgtgttgatgaccttccctgaaccctggctttcttctctatagaaagtgctcagtgggccaagcacggtggctcacgcatgtaattccagcactttgggaggacaaggcaggtggatcacttgaggtcaggagtttgagaccagcatggccagcacggccgacatggcaaaaccccgtttctactaaaaatacaaaaaattagtcgtgtgtggtgctggcatctgtaatctcagctacttgggaggctgatgcaggagaattactcgaacccgggaggcagaggttgcagtgagctgagatcatgccactgcactccagcctgggagacagagtaagactctgtctcaaaaaaaaaaaaaaagtgctcagtggtaatgcctatcccataggacgactgtgagattttgaacaataacatatgtcatgcctgtgcttgaagcctggcatgcatggccctcaggaaatgtgtacactgacctgggcataggactgagactgtcagagggaaacacggggcctgggagtagaccctgcatgctccgagggtctgcttccatgtgacgtggactgaaggtccctctcctgattcttcatgagatgagccagacaaacatcttatgagtgtcaccagcagcaatcaagacaggaagaaaggggcatcatgtcctgtcatgaactagaaagggggggcaggacagaaataagtggagaaaaggagatcctgaaggttccatgtcctccccagccctcacctatgtgagcacaggtgagcagacagaagctgagaattcgcactaataccttcaagtctggggtgatggggtctgagttgggtgcaggtagttctaggacaattttttaaaatctctttaaaacagaagctcctacgcagcaactcaggagctcaaccaagaaagaaagggccaggactgagggacggatgacgctcactggagcagaactgccctggctcggtcaaggggacatctctagggaggtcctcagagggaagagcaagaacccaagacctagcaaggatgtgctcagcccctgggggatctccccaccctgtcctaagttagacagtcaaggccaaaggcaacatccatgtctgaaatggagcctctgacaggagaagagaaactggccctggtgggtctgaaggctgtcggggcagggaagaattgtccgggccaagcccaggagcacaaggagagtgggtacatcaaggtgcatggaagcacaccacagcttatttggcaaacagaaggtcagcagaaacagagcttgaaaatggggaaagaaacatcaacccagacgccaaagctccccacaagaacttcatggaacctaatacacacataaacttaacaaaggaaggactcaaagtgagaaaaacaagactatgatgaaaagaaagctagagacagaactaaggaaaccaattacagcgtgagaattaaaaccccatcactgcaaatctagtaaataatttagaaacagcaaggaacagagtagacatgagtgaaaattcaagataatggcatgggggaaggtgtgagatctccacagtaattttgtagaagaaggaagagacaaattacaatgaagaggacccgtaaggagattgggaatttttttttttaactctagaaacaaatgtgctttgtgatgagagacctgtaatctaaaatttagtattctctcttcagtttcatttcaattctcctgttaatttcaaacaaagacaattttttaaaacatacacattattcttccatagcttgtgtcttgtatcattatatgatcgatagatttctgaatttatgaccacataacagtctgatcgtttctggatggtatacttctgggtaattcattgcctttgctgttgtacttttctgtatttgcttaaataatttatgagagacatgcattgttttttatttttaaaagtataatcttggccagatatggtggctcacacgggtaatcccaacattttgggagggcgaggtgggcggatcacttgagatcaggagttccagcccagcctggccaacatggcgaaaccctgtctctactaaaaatacaaaaattagcagggtgtggtggtgcacatctgtaatcccagctactcaggaggctgaggcaggagagtcgctacaacctgggtggtagaggttgcagtgagctgagatcgtgccactgcactccagcctgggtgaccgagtgagactccatcccccccccaaaaaaaagtatgatctttaaagggaagaaaatccactcaacattctttcaataagtagatattacacactatattgtaggcactgggattatgagctaggccaagaccttgcccagcttccagataaagtcatggaggttatagattcaggaagacaaacattactccaaatacagttcattccagaaatgcaagagtgattcagcattagcatatagtccatcctgttaacagagctaaagagaaaaattatatgatcatctctacagatgcaccaaaggtatgtgaaaaaatcagcattcattcctatgagaaacaacaaaacagaaactgagggataggataaagtcatgcctaacaagatagaaaatacatatttatgcaacacatacctaacctcaaaagccagcatcttaattaacaaagaaaaactaacttttcctgctacagtctggaacaagacaagcactcactctttaacactgggtctgaagtattagcccatgtacttagacaagagaaatcaactgtagaaataacattcatgaaagaagaagttaaaattatctttatttgcagagcatatgtttatgtactcacatgtggaaaaacaaaagaatccccacaaaacaagcaccaaaaaaaaaaaagaaagaaaatctaataagaaagctggttgtataataaatataggcataccttgttttattgttcttcactttatcatgcttcacagatgttgagtttttttacggattgaaggtttgtggcagccctatattgagtaagtctatgagcaacatttttccaacatcatgtgcttactttgtctctgagtcatattttggtaattctcagtacatttcaaactttttcattattactatatctgatatagtggcctgtgatcagtgacccttgaagatactattataattgttttggggctccatgaactgtgcccatataaggcagtgaacttaactgagaaatgcatgtgttctgattgcttcataggctggccgttcccctgcctatctgttccctgagacacaacaatattgaaattaagccaattaataactctacaatggtctctaaatgttcaagtgaaaggaagggtcacacgtttctcattttaaatccaaagctagaagtgattaagcttagtgaggaaggcatgttaaaagacaagagcagccaaaagctaggcctcttgcaccagttagcaagttgtgaatgcaaaggaaaagttctcgaaggaaattaaaagtgctactccagtgaacacacgaatgatcaagaaaacagccttatcgctgatttggagaaactatgagtggtctaacagaagatcaaaccagacacaacattcccttaagccaaaatctgatccacagcaaggcccgaactctcttcagttcaattcaatgaggatgagagaggtgaggaagctgcagatgagaatttgaagctaacagaggttggttcctgaagtttaagaagctgaggcagcaaatgctgataacctgcaagtccagaagatccagctaagataactgatgaaggtggatacatgaaacaacagattttcagtgtagacaaaacagccttatactggaagaagatgccatctaggactttcatagctaaagagggaaagatgacgcctggcttcaaagcttcaaaggacagactgactctcttgctaggagctaatgcagctggtcacttaaagttgaagccaatactcaaccattctgaaagtcccatggcccttaagaattatgctaaatctatttcacctgtgcactagaactagcccaacaaagcctggatgacaacatatctgtttaaagcatggtttacttaatatttcaagcccactattgagacctaacgctcagaaaaaaaatatgcctttcaaagtattactgtttattgacaatacacctaagagccctgatggagatgtacaagaaggttaatgtcatttttctgccagccaatacatctactctgcagcccacgggtcagggagtaactcactttcaagtcttattatttaagaaatgcatttcacaaagctagagatgccatacatagtgatcctgtaataaatctgggtggagtaaattgacaaccttctggaaaggattcaccattctaggtgccattaagaacatttgtgattcatgggaggaggtcaaaatagctacattaacaggagtttggaagaagttgattccaatcctcacaggtgaccttgaggttttcaaaatttccgtggaggaagtaatcacagatgtggtaggaacagcaggagaattagaattagaagtggagcctaaagatgtggctaaattgttgcaatctcatgagaaaactttaatggacaagcagctgcttcttatggatgagcaaagaaagttgtttcttgagatggaatctactcttggtgaagatactgcagacattattgaaatgacaacaaagggtttagaatatgatataaacttagttcataaagcagcagcagggttagaggactgactcaaattttgaaaaaagctctactgtgggtaaaacgctatcaaacagcattgcatgctacggacaaatcttttgtaaaaggaagagccaatcaatgcagcaaacttcatcactgtcttattttcagaaattgccacagccaccccaaccttcagcaaccaccaccaattagtcagcagccatcagcatctaggcaagaccctccaccagcaaacagatgacaacttgctgaaggctcagatgactgttagcatttttgagcaataaagtatttttaatcaaggtatatgtataatttttttagacatatgctgtggcacacttaataggcaacagtataatgtaatcatagttttatatgtactgggaaactaaaaaattggtgacttgctttattgtgatattcgctttattgcactggtctggaactaaacctgcaatatctctgaattatgtctgtatacaaaaatcaataatgtttatccataacatagataaacagttagaaaatgtaatagaaggccaggtgcagtggctaatgtctgtaatcccagcactttgggaggccgaggcgggtggatcgcttgagctcaggagtttgagacgatcctgggcaacatggtgaaaccccgcctctaccaaaaatacaaaaattagccaggtgtggtggtgcacacctgtagtcccagctacttgggaggctgaggcaggagaattgtttgagcctggcaggcggaggttgcagtgagccgagatcgtgccactgcactccagcctggtgacagagcgagactttgtctcaaaaaagaaagaaaatggtgacatgcttgtgaaagtaaagagtattttgaataaatggaaagaaatatattcttggataagaagatacaacagcaaagagatgttaattctcctaaagttaatctataaatttaatgccatattgattaaaaaaaatcatcattgtctcctagaagctaggcaaactgattatatagttcttggaagaacaactaagcaagaatcacaaaggaaactccataaaagatcaataaggaaggctagcccttccagatattaaaatgtatttaaagcccccctcttggccgatgaattgacagaccaataaaataaaacggaaatatccagaaacaaacacatttgtctatggtaatttagtatatgacaaaggggtcatttaaaataattgagggaaacatacacttttcataagtagtactgataaatccagatgggatggccatatggaaaaagaaaaatacacatctgtttctcaccagttatatcagaactgattccaaatagattagaaacttaaatggagacagagagaccccactttaagtattagaaaaaaacatggaattcctctctaaccggaaagttgagaaatatttcctataactcacagtccaaagtaataagggaaaaactgatgaacttaactacataaaatacaaatctttacatatgaatactaccagaagcaaataaaaaagacaaatgaaagacaaatgataaaccgcattatgcagtaaacaggaataagaaatgtctttatacactgctacagactgaccccacgcgatatcactaagttataaaaccaaaggctggaacaatgtgcaaggtaggcacacgtacatgcagtatgtgtacagcacatgtgcttgcttataatttagaaatgaaaggacaaagcgaaaatctaagagtagttactatagggccggggggtggggagacaaggaatacaaacaggacagaaatgataactagaattttcaggggaaaacactttactgcatagatttgactttgtaacagtaaatgtcttatataattatgaaacaaaattaaatcaaaaattaattaaaatccctaaaatcaaaagcaaaatgaaataagtgaaccagtaaaacgggcaggtgccttaaccacagagagcggtttaaactgactgtaacatatcaccatttaattgtatatctcaagtggtttatttcctgaaggataatcaagagacatgggagctctggtggcctctgctcactggggccagcaagggaaaataaagaagagagacagagagacttaagagacctaacaacccaatgcaaaaagagagaaacaggcacacagaaatttgaacatgaggtatttgatgataaaccaaattattggtatctattagttgtgatcacggcattgtgactatatcattttaaaaataaaaaataagggccaccttctcttttagaggtaggcatgtatgtattttgacacaaaataatgtgatgtctcaggcttgctttcttcatccaagggagaagtggtggggtactgatgacgcaagaatgtccaggagtggctggcagctatagctgagtaatggatgcatagggttcaatatgtcattctctttacttgtgtatatagttgagatatccacaatgtaaatgtcgaaaaatatgaaaatatgggttcagataataactctgctacttagtcacacagccagtttgtaaaaatttcctatgttttgggaacctgaattccttccttttaaaaagaagacacataaacctaagttacaagacaaattagtatatgataaagaggtcacttaaaatcactgggggaaacaaatattacaaatttgttttattacatattacaaagcctgtcatatagcagaactaaacaaaggccagttattttttattttggtatgaatttaactatgccaaattactaaaaatattttcctaaacatcacatcaaagtaagatttcacatggagttttaaagaggaaataaagaatgaagccttttggttttataattacacaaaatagcaatactagaatagaactaaatttatgcccaaatgtattcctcaattagtgcccaattcaaataccagatacaatgatgttattctgagtaacacccataaaactacatataactattaccataaataacatttaatttgtgggaccgcagttgctaagcctgctgtacctaaaactttgctgacatattctgcctactgtttcataaaaaacacacagtaatcagattaggtcaattagaaagctacaggcaaaacattgttccctttcaaatgtcctggtaaatagaataattttaaaatgaagaaatatttgaatcaaaatagtcaggaacagacctcaaagcattaaagaactagatctttatactctcgagagttgcattcaaagactcaatcaaattcaagttcatcacatatgcaaaacggaacacgaatctcccattaaaattatcataactgctggcttattaaaatgcttgagtgcattagacatagcatagaaaaattcaatataatatcactccaataatgtttctatattaatctagaaaacatggggaatggccctaaagcaaaaagtgctgctacaggctcatgcagaattgaacttatggctgttgaggccaacccacctcaaagaggcaaaaactgtcacagcagcaagatccagaggccttcatccgacccgggtgggatgaagagaagaattctcagcactgacccacagaaggaggcgggaggctgtggtgagatgaacagactagcgcccactctggctagctctcaaggtgagatgagggtgtggcttttgcacggtggcaatgtcgatgattttgaaacctcatgacagtgtttctgaatgtccaccgaaacatggctctcacaggcaacaaaacactcctgattagaggtgtaaattttccgcgtttccagagagctcttcatatgttgatggaaaattcccagcaacaaacttgaaggagtaattgcaggcaggccgtgttttattgcacttcgttgcattgcactgcacagatactgcgttgttgataaattgaaggtttgtggcaaccctgcaaggtgcaagtctatcagcatcatttttctcacagcgtgtgctcacttcatgtctctctgtcggtatattttagcaatgaagtatttttaaattaaggtatgtacacttttttttttgttttttgttttttgagacggagttttgctcagtcacccaggctggagtgcagtgtcgcgatctcagctcactgcaagctccgcctcctgggttcacgccattctcctgcctcagcctcccgagtagctgggactacaggcgcctgccagcacacctggctaattttttgtatttttagtagagacggggtttcaccgtgttagccaggatggtctcgatctcctgacctcgtgatccgcccacctcggcctcccaaagtgctgagattaagggtgtgagccaccacgcccggccaaattaaggtatgtacactttttaaagatacaatgctactgcacacctactagactacagcttagtgtaatcgtaactttgatatgctctgggaaaccaaaggatgtgtgtgacttgctttattgtgataaccgtcttattgcaatagtctgcaacagaacccacaagctctccaaggtaggcttatacattttcctattggttggcttagtgcaaaagatgaacccaaactggcaaagattaggtagaaaccagtttctgcaaactgaatgctccctttctccaggaacatctaccatcacatagccatttcctctacaaaactgttaccaaagagaagccaatttgtttacagtcatatgtaaaattaaaagcaacgattaactgtataccacctaaagtacctactctattcaaaacaaagctatgaaaagtaagaacatctcattttgccatctgcactgcatactcaaaccaaggcagagccctgagaggaagtgccagggagaccctcacaaccgccatgggtactgaagacacgagaaatagttaatggcaggccacttcttacttcacttcagatgaacggaaatctgaaggcttccatgttctataaactcttgggttttcacattagagaccagtggagagaaagagaaagtgcaagccagacccctgctttaaagcactgaccattcttttggaacaagaagctcagacagccccagtttcctctgaagtagcacaagtcaatgcaggctgagtgaacagaggtcctgggttgttcaagtgccatctaattccctattgaaattcactgctgccatcagtccaatggcagagcatctgtgcccctggactagggaagcggagatgcccagatttctgacacataaaccactgggtgagaaattcatctggaataacaaatttatctttaaaaagccaaacaaggacatccagtttcagttccaacacgtaaaaagcttggagttgtcactcccatccttatgataagaaaaaagctgaacaaacagaaactcagcaacctttcttggacccctcagagagctgaggttgcagaacaaactgccactgggaaatctgaagagatgggaatgcacagggtcccggctgagatctgctcacctagagatgctgctgggccagcccccagttggagcctccaaacgttaattctgacaaattgctggaggctgagggtggaccagcctccaagtgagactgctggggctgcagttttagggggacaccctacacttttgtgtgttttgcctctgagaacatcaccagattctcagggttaagagccctgatggctgtagcaggggagggaaaggctagtcctagtgacaaatgaacagaaccttctccataacaaaggcctgctctccaacacagtattccatctgggggaaggcgttttcctgaccccatgcccgtgcagccttcctgtctcacctaaggcaggaataaaaggctagaaacgcttgttaaggtgatagcccagagatacaggcccactaaaagactgaaatttcatcatcagagtaaaacacaccacacacacaccttcccaccacagcaacagggctgcagtataactaccacaaattacagttgaaggagctgctagacacaagaaagcattcttagggaaatccaaagacaagaaaaggacaaaaacaagagaaataggtgaatttgaaccctctggcacctacagctacagcaaatattaagagcctaataacagccatattaatataaaacctcacaggtaaggcctgtttcctttaattcttattatctgatacactatatttggttttcagcaaaaaattagaaggcatggtaaaaggcaaggaaaaaagtctgaggagacagagcaagcaacagaaccagactgagacacagcagagaatttggaaggactaaatggggtatttaaaaccactgtgatgaatatgctaagggctgcaatgggaaaaatggacaaatatgcaagaacagatgggtggtataagcagagatggaacgtctgagaaaaaatcaaagaaaatgctagaaatcaaaaacactgtaacagaaatgaaaattgcctttgatgggctcataagtagaccagacacagctgaggaaagaaacagtgagcttgaagataggtcaacacaaatgtcccaaactaaagtgcaagaaagaatgagaaaaaataaaaataaaataaccaccataaaacactcaagaacagttgtataatttcagaaagtgtaatatatgtataacaggaatattaaaaggcaaaaagagaatggaatagatgacacatctaaagtaatataaactgataaactttccaaatgtaatttaataatgataaattaaattacatttattttatttaataaaataagctgatagctttccaaacagaccccaaaccagagatcaaagaagcttggagaacccaaacaggataactatcaaaaactctacgctgaggcatctcattcaaagtgcagaaagccaaagtccaagagaagatctagaaagaaaccagagaaaaaaataacaccttaccatagatgaacaaatataagaattacagtcgatttatcatcaaaaggcaagcatgaagagcgtggagtatttaaagtgatgaaagaagaaatcccaccaacctagacatgtatatccagcaaaattatcccataaaagtgaaaaagaggctgggcgcggtggctcatgcctgtaatcccagcactttgggaggccaaggcgggtggatcacaaggtcaggagttcgagaccagcctggccaagatggtggaatcccatctcaacaaacaaacaaaaaaattagctgggcatggtggcgggcacctataatcccaggtactcgggaggctgaggcaggagaattgcttgaacccaggaggtggaggttgcagtgagctgagatgatgccactgtactccagcctgggtgacaagagtgagactctgtctcaaaaaaaaaaaaagaaaaaaaaaagtgaaaaagaaataaagactttttcggagaaaggaaaatgcaggaaatgtgtcaccagcaaagtgacctgcaaaaaatgttaaaagtagttctttgcaatgagaacatatggacacagggaggggaacaacacacactggggcctgtttgggggagtgggcggggagggagagcattaggaaacatcactaatgaatgctgggcttaatacctaggtgatggattgataggtgcagcaaaccactatggcacacgtttacccatgtaaccaacctgcacatcctgcacatgtaccccagaactaaaaattaaaatttaaatttaaaaaaaaggagttctttgaagaaaggaaaatgaaataggtcagaaactcagatctacacaaggaaagaaaagagctttgaagaaggaataaatgaaggtaaaataaagtcttatttttcttatttttttaaaaatttgaatataaacttattttttaattgacaaacttatatatatgtattatgcacatcatgttgttttgaaatacgcatacattgttgaggggttaaactgagctaattaacacatgcactgcctcacatacttattttttgtgttaagaacacttaaaatatattctattggcaattttcaagaatacactacattgttattacctatagtcaccacattgtgcagtagatctcctgaacttatcccttttatctaagataaattttttatcccctgaccaacatctcctcaaccactcatatattttcttattcttaattgatctaaaagataactgtttgcttaaagtaatatgaaagaaaaataaatcccgggaccctaattcactatggcaaagggaaaaattaagttggaagctgagtcacacaagaagctgcctttccttttgttgcccagcagacagctaaagataaaaggccagacagaggccagctgtctccacgagtgctgctctgtgtttactttatcttgtgtaaagtgtcgacttgctgagcactagatgaatatataatcgattatttctatgtctcctccttttcacgtgcaacacgtggattcagtgatgtgaccacacccaccctccttcccttcctgcccacttttcccctttaaatactgaagacctcaaaatcctcttgggaaaaagtaagatcacagattgttcctgtggttttgtgttcctttttcccggatgcatccttaaccttggttaaataaacctctaaattgcttgagacctgtctcagatacctttcggtttacggtaataatagtcaacatctattgagtgattatagcatatggataaatgcaatgaatgatagcaatgtcataagaaatggaagaaggaaacagagaatactcatttataaggtacctgtgatactgtgaaatatttggtcttgacctctttttttggcaaacaattcctaaaatccttggaatccccaaagtccttttgctaatgatgctaatgttaactgacagcttcaggatggggttgctcactggaaagacagaggcaggattagagggttgggactttcagcccaatcccccaaccccagggagtggagagggcctgaaggctaagttgatcaccaatagccagtggtttaatcaatcatgcctacacaatgaagcctcgataaaaacccaagaggaccgggttcagagagcttcctgatagctgaacacacggaggttcctggagggtggcgtcctgaagtgggcatggaacccaagtacaccttcctcctatcttaccctatacatctcctcatcggtgtcctttctaatatcctttataacaaaccagtaaatgttaagtgtttccctgagttctgtgagctgctccagcaaattaatcaaacccaaagagaaggctgtgggaaccccaaatgaaagctgattggtcagaagtcctagaggcctggacttaggactagtgttgggagagggggcagccatgggttccaggctctgcaccagtgaggtctgaggttatttccaagtagaagatgttaaaattaaattagagaataagcatctggtggccactccctgctgtgtggggaaaacccccacaatttaggtcacagaaggttctgtgttgattatcgttgtgctgtgagagcagaggaaaaacacagtttgagaaattttttcccaaacagtacctattctagatatgaaccagtattgtgttatttgagagtgaatatagagtagttgaaaatgtagagtgaaaactctagggcaaccactaaaataatttgtaaaagaagtgtaattgatatgctaaaagaggagataaaatggattcattaaaaatgctctattcaaaccagaaagggcagggaaaaaaagggaaagaagtgaacaacaacaaaaaatgttacaaacatagtagaattttttttttttaatacagggtctcattctgtggcccaggctagagtgcagtggcacgatcattgttcactgcagccccaaccttcctgagctcaagtgaccttcccatcttagcctcctgagtagctgagactacaggcacacatctagctatttttttatttttattattattattttttagagcctggtcttgaactcttgggatcaagcaattggcctaccttggcctcccaaagtgctaggattacaggcatgagccactgtgcccaaccatgtagatatttttaactacatcaatccaactgtgcaataatcactttaaagtaaataacctaaatatcccaattaaaagacagaaactatcagagtagataaaataaaaagccaactatatgtagtctacaaaaaatccactttatatataaagactcagattagaagtgaagggatgaagaaagttatagtgtgctatgctaatcaaaaggaagttggagtaccaatattagtttcagagaaagcagactttaggacaagggaaattatcagaggtcaatacgagcatccatagtgatataaaggtcagtttccaagaagacataacaatccttaacatgtatgcacctaaaaacagagcgtcaaaatacatgaggcaaaaactgacagaactgaaaggaaaaatggacaaatgtactattatagttgaagacttcaacattttcttcttagtaattgatacatcatcaacatctatagactacatccaacaacagcagaatacacattcttctcaagctcacagggaacattcaccaagactgaccacattcttggccagagaacacacgtagacaaatttaaaagaactgaaatcatacaaagtatgctcttagaccacagtagaatgaaactagaaatcactaacagaaaaagatggaaattcccaaatacttggagattttaaaacacatttctaaatagcatatggttgaaagaagtctcaagtgaaatgaaaatatactttgaactaaatgaaaatgaaaatacaacttatcactattgtgtatagcaaaagccatactcaaggagaatttgcagcactaaatgcctataacagaaaagaagaaacgtttataaccaataatataagcgtgtaccttaggaaactagagagagaagagcaatccaagcataaagcaaacagaagaaagaaaatactaaaaattaaggcagaaatctgaatagaaaattgaaaaataatagagaaaattagactcagaaaaaaggatacacaaattattaatatcagaaataaattaagggattaccaatattaatccatggacattaaaatgataacaaaggaactctatacctctaaatttgacaaattagaaaaaggactaattccttgaaacatacaaatgaccaaaactcatacaaggagaactagatcgtctgaacaggtttaaagctactaaagaaactgaatcaataattaacgatattccaaaaaagaaagcagcaggcccaggtgatttcactgacgaatcctactaaacactgatggaaaaaatagtatcagttttctgcaatttcttctacaaaacagaagcagagggaacgcttcctaatttattctatgaggccagcattaccctaatgccaaaaccagatacatagagcataaaaaagggaaactacagaccaagatctctcatggacataaagttctcaacaaaatattagcaagactaaaaatgtatgaaaagaattatatacttcaacccaatgggatttattataagtatgcaagactggtacaatatttgaaaatcagtcaatgcaatataccacatcaacaggctaatgaggaaaaatcatatcacatcaattgatgcagaaaatgcatctggcaaaatctaacactcatttatgaaagaaaattctctacaaactaagaacaaagatgatcttcctcaacttgataaaaagtgtttataaaaagctaacatcacacctaataatgaaatactgcacactttcccccaaaaaagaacaaggcaaggatatcctctctcactacttctgttcaacatcatattagaagtcctagctagtgcaataagacaagaaaaggaaataaaaggtacatagattgaaaagtcagaaataaaactgtctttgttcataaatgatatgattgttcatgtacaaaatcccaaagaactgtcaagaaactctcaaactaataagctagcataggtcacaggatacaatattaatatacaaaagtcaattgctttcccatattccagcaatgaaaaattggaatttgaaatttaaaatgtaccattaaacactgcaccaagaaaacgaaatacttaggtataaatctgacaaaatatgtataagaactatatgtagaaaactagaaaactcaaatgaaagagttcaaagattacctaaataaatatagagatattccatgttcatggacagaaagacaatattgttaatatgtcaattcttctcaactagatctataaatccaatgcaaccctaatcaaaatccaaaaactattttgtagataaaagctgattctcaaacttatatgaagaggccaaagacctagaatagccaacaaaatgctaaaggagaagaaaaaagaagttgaagcactcacaatacccaatttaaagatttacaataaaaatagtataaacaagtcaacatggtattggcaaaagaacagacaaagagatcaatttaatggaattgagaacccagaaataaagcccataaatatagttaactgatctttgaaatatcaacaaagtcattcaatggaaaaaagagaagatttttcaacaaatggtgctggaaaaattggacatctatatgcaaaaaaaaagaaacctagacataaaacttacaccttactcaaaaaattatatcaaaagggatcatgcacctaaatgtaaaatgcagaactataaaagttctttaagaaaacacagaatatcttggtgatttggggtttggttcaaagacactgttaagagaagaaaaagagaagtcacagactgaaagaaaatatttgtaaaacacatatctgataaagaatttgtatccaaaatgtataaagaaaagtaaaactcaacaataagaaaacaaaatgtctaactttaaaagaaggtggctgggcgcggtggctcaagcctgtaatcccagcactttactttgggaggccgaggtgggaggatcacgagattaggaggttgagactatcctggctaacacagtgaaaccccgtctctactaaaaatacaaaaaaattagccaggtgtgctagcgggcgcctgtagtcccagctgctcaggaggctgaggcaggagaatggcgtgaacccgggaggtagagcttgcagtgagccgagattgcaacactgcagtccaggctgtgcgacagagcaagaccccatctcaaaaaaaaaaaaaaaagagggtaaagatctgaacaaacatcaccaaagaagatacaggaacagcaaataagcatatgacataatgttcaatatcatttgccagtaggggactgcaaattaaagcaacaataagataccattacatacctatcacaatggctaaaatccaaaaatggacagtatttgttgtcagttgctgatgaggatgcaattgctagtgaggatgcagaccaacaggaatttttatccattgcttataggaatgtaaaacagccacttaggaaaacagtttaaaagtttcttacaaaacgagacatagtcttattgtatgatccagcaatcatattcctaggtatttacataactgatttgaaaacacctgcatgtgattgtttatagcagctttatttttaattgccaaaaactgtaaacaagcaaggtatcttaaataggtgaatggataaacaaactgtggtacatctacataatgaaatgttatttggccataaaaataaatgaagaatccagccataaaacaatatggatgaatcttaatgcatattgctatgtgaaataagtgaatcttaaaaagtaacatattgcataattccaatgacatggcattctggaaagggcaaaacggtagtaatagtgaaaagatcagtaagagttcagggagagagggaaggattaaataagtgaagtccagagaatttttcagggtggtgaactatttttatgatatgtaattgtggatacatgactatgcatttgtcaaaacccattgaactgtacaggccaaagagctaatctgcagatatgctaacttttaaaaagtatttaaaaggtgggaggatctcaggatcctaattttgcaaaatgtgacaaaaaacaatctacgaaacaacctcactgaaaggggttggggggaaaaggtgctgacttaagtaactctgaaaatcatggagtctgtaatactaaaggccaaagaagctgtacatcagtgatgaactctagttgataaatttgtttcccaggtgggcagtggttaatagttctgataccactactcacgtattttgaaactgaccattaagtaaatggatggcagatggtgagaaccaggtttctcactgctggagtgggaacaggggaggaggctggactgatccacgctgtaaaggattggcattgaagacatcactatgaactcatgtttagcttaatagactattgatggttatatatagaaatagttacaggttacaggtatatacatgtgttggtatacactcatatacagtcgtcctcccttatatgtgtggaataccctattctaatacccctgtaggtgcctgaaaaaacagataatgctgaaccctatgtatactatgtgttttcctatacatacatacctttgataaaatttatcattaggcacagtaagagattaacaatgatccctaataataaaatagaacaactaggctgggcgcagtggctcacacctgtaaccccagcattttgggaggccgaggcgggtggatcacgaggtcaggggatcgagaccatcctggctaacatggtgaaaccccgtctctactaaaaaatacaaaaaattagccgggcatggtggcaggtgcctgtagtcccagctcctcgggaggctgaggcaggagaatggtgtgaacccaggaggcggaggttgcagtgagctgcgatcgcaccactgcactccagcctgggtgacagagcaaggctccgtctcaaaaaaaaaaaaaaaagtatgaattgttcatctctaaaatttgctatttaatatttttggaccatgattgaccgcacctaactgaaaccacggaaatgaaaactgcgaataaagaggaaccaatgtatttccttgttttgtcagctgagtgaacctagaagcaaaggcctctcccccacccagtaataacaagcacacctggcactgagattttggtttctaatgccaacctccaaccaaaagaaccagagctttcttggagaaatggccaatttgcccatggactagggcaggaaacatacaaaatgagccaggaacctcttgtggtgccagaaagtaagaacgtgataaaaattaataacctcacaatgatgggggtgtgtcaaaggaacacagaagccaacttttaacaataaagtaacattggattataactgtgagtataaaataaatatccatgagtccatatttctataaatacatgattgaacacacaagtaaataaatagtaaagaagggacaaatctcccaagggaaaaaattccaaatactttatgtagatactccgccctcagggaagaggaacatgattccccactccttaagtggaggctgcacatagtgacttccttccaaagaatacaatataggaaggtgggcaggtagaacttcacagtagagaaaactgccaatcactccctcagtgatcacctggctaggtgatcaagtcaacatcaacagtgatgccttactgatagtatgtccccctgatgtgatgagataagaacagtcttggccgagcgcggcagctcatgcctataatcccagcactttgggaggccaaggcaggtggatcatgaggtcaggagatggagatcatcctggccaacatggtgaaacccggcctctactaaaaatacaaaaaaaaaaaaaaaattcagccaggagtggtggcatgagcgtgtagtcccagctactcaggaggctgaggcaggagaaccgtttgaacccgggaggcagagactgcagtgagccgagatcacgccactgcactccagcctgggcgacagagcgagactctgtctcaaaaaaaataaataaataatggtctttacctctctggtcttcttcctccaaatccagtctaatcatgagaaaaacatcagagaaatcctaatagaggggcaccctacgtaacactgaccagtactgctcaacactgtcgaggtcatacgaagtgaggaaagtctatgaaaaagccacaactgtgaggagcctaaggcaacatggcgacgaaacgtgatgtggggttggatggtatcctgggagagacaaaaaacattaggtaaaaactaaggaaatatgaataaccatggactttacataatcataatgtagcgatattggctcattcattttaacaaatgcaccatagtaatgtaagatgttacaaacaaagaaactgggaattctttacactatcttggcaatttttctgttcatataaaactattctaaaggatgaactttatttaaaaatccaaatggcaatcacaacgcataaatatcacagccaaccacaccccaccccacagtaagttgcttttataaaccaacagctgctggttgctgcagaatccccagggccaggctcaggggctgtgtccccactatacccagggcaagcccctgagctgccactgccagggattcaatcccccacccaaattaatttacatgtggtgtgagttttacactgacggaatgagggcttaatgtttgcttggtgtaaaactgatgtatggaggaataattttagagcatgacttttagaaggaccaaagagggcagcttctcaatcggcagcaggtggcacgaggatcaatagctgacgtctgtgccgctggacagcaggcccgccgggaggagggaaaagcacaatggacacacatgaaggacccagtgaggactgagtgatgggctggggacacctctcatactaccctgtcatgaaggccacagtgcaacacaggagatggggaggtcaggtcagaacacctgtccggggcctctcgatgggcactaggaatctgagacgagtccttggcactgatgctcaaaacatctttcatacctccagaaattgactctcctaatccagtttcgagcaggagggactcatctatctatgtgcaactgacagaattagagggttcccttgtgacatctaaacatccccatgaactgagcatactgtatgaacactggtgcaccgatattcagcaatgacagcatgatcgttaatccaccaaccaaaaatgcaagctgagcggctgggaagacaagtcacttgcccttgcaggctccgtcttctcaccccaacaattctacttaagtaaagaaaataaagcacaaaagctttgaaaccacggctgatagtgcaggctcctcaggggaaaggcaggcacccgacagaccaagaatctggtttccacacccatcacacctgcagcactgattcaccagtgcagctgaggtgatggaagcagggaaagtctaaggggagggacaccgaatcatccccaaaaccacaacagaattttctctgtgaacctctccaacactgtcagcctgattcttctgccaggattaactgaatataaacacctaaagcataaataatccgtgtcaataatttaggtgtacagtaagataaagtgcactgctcaataggcaaaactacagacaaaagaaaatatactttaataaaatttacactagtaccagctaaacaagaggtcgaagaaagttgttaaatttctcatcgcatcctcaaagatataacaaagttaaacaggaaattacaaaaagaaggtggttttaaaattcagcaaaaaaaaagatgaaatcatcgtgaccccagtgtaactctatagccatagctttacatgtaaacactggatttaaaatgcaaaatctgtggttactttagaccactgagactcaattatttatgctgattatttataggtagcttctaatggaagttgattattgaatattttcaaagagaaaaaaaaaggaataaattctcatttcgctaaaaagctttgagtttttttcctgaagggaagaaaatagattaggtggtgtcctgagttcctctgcagcctggggtgctggcatgaataaataaccgtggtaagaagcaagcatgctagcagccaagccacagacaatagtgcccaatgcatcgcccatcttcagaaacgaaacatgttgcataagacattttcctaaaaacttcatacttggagccgggtggggtggctcatgcctgtaatcccagcactttcggaggccaaggcgggcagatcacctgaggttggaagttcaagatgagcctgaccaacatggagaaaacctgtctctagtaaaaatacaaaattagctgggtgtggtggtgggcgcctgtaatcccagctactcgggaggctgaggcagcagaatcgcttgaacccacggggcggaggttgcagtgagccgagatggcgccattgcactccagcctgggtaacaaaagcgaaactccatctcaaaaaaaaaaaaaaaaaaaccctttatactcggactttaagcatgagtctttctaaagtgcattctaattagagcacatggggctagataggggtgactggcagaaactggggaggtccgaaaatgcccccctcagagaactgacctaagaaagcagctagagcctgaggagacccactggaggtcacatagagtgaagtgacatgaagaaatggctatggacacagtcctgggaaaccagggagaggccagagaggggtcacagtctgtctttagagcagaactagaattaacatcaaacgccaccataagcagaaaatagaagctgatgccacctctgacctctgagctgagaaaagtgagtccatacagggctcatgaaggccttagaagggcctgcagagaagacaggagcactgtgcccaggaggcagcctggccagcagtccagagacatccagcaccccccgccccacttgacacaggcgcatcagggtgagcacctgtgatgagaatacccactccctgtgcacacagtacctgcatggccctcccgggcacccggctttggggggacacgtgggcagcgagctacacacagaccctatccctccagcaggatcccccttcctcatttgcattccatttagtgataagattttccccatagccttatccattttctcttactccccaaggaaaaataatcagaattattagttttggtggttatcctatgttatggggtgaatctgtccttcccccaaaattcacagaaattcctaacctccaatacctgagactgtgaccttattggaaataggttcactgcagatgctattgactaagatgaggtcatatgacagtaggggaggcccgcggtccaatctgactgtgtccttaggaaaagggggatttgaacaccgagacatgaacacgaggagaacgccatgtgaataggaggcagagacggggtgatgcatctacaagccaaggaacgtcacgtcacggattaccagcaaatcacaggaagctaggagggagacctggaacagattttccctcagggcctcgagaagaaatccacgctgccaacaccttgatctctgctttccagtctgcagaactgtgaaggaataaatttctgttgcttaagccaccttgtctatcgtactttgttatgggagcccaaggataggaatccagcctgtaatgtgaacttcagttttacagagatgttccagcaacttccccgggacatgataacccagaaaacaagtgaagaaggtcccgggggatcctgctgttgtcacacttcaaggtccctgtgcctgactcatgggaacccccaggccttccatcggagactacgcgactcttactagaagctcaggaaggtacacaacccagggcaggcagaacactttatctctaatgagcagcaagcagggctttcaaggcagttaagaatttcctagctgttttcttcctcatcgcaatcaattctgaaaggcatgttttcatagttcgaggattctaagggctacgatgaaagtctctgctattaggttaaacatttgaacaacatattaaatattcaaatagaacattaggttgaactttgactgagcgtattaaaatactttaaggttaacactgaaaaggaactttttgtagtaaattaaaggtggcttctcctcctgaaggaaagtggagtctaattcctagcctctcgcacaccggccggcctgtgacttgcgtgatccagcgaatgtgacagaggtgacactctgggacacgggaggctgagttgtaagaagcctcttggagcctcttagaatgctggctctggcagaagccagacactatgtagcaagtatcactcacgtggtgaggaagcccaggtacccacatggagacgccatctgaagacagaaaggtgtctggccagccctggctgctctgtctatcccagccaggcatgtgagtaaaggaacctttttggacattccatcgcagcagaaatgacatgcagaagacccagggaacccagccaacagtgggaaccaagatcccaaacgtatggccccagcacagctgccccggccatctccagccatcagtgagggttctagtcactggtctgtctctgggtcatcctgctaaattcctcactcacagaatcatgaaaagtggttgcttagtgccactatattttggggtggtttattgtgcagccatagataactggagcacacttttctgtgaagtattttctttccagactcgaacagttagatgggtttatccggaggctacggtgtaattgaaattccattaaagatgctttttaacaagtaagcaggactaatgtatcttcccactgcaaaggcctgcactatctttgccaaaccacatcatactctgtgaagtcatccagtacaacacgtaccccaagttcatactctttaacagctctctgaatcaaatggagacttagtcagggtgaacagtgtcactgcaacgcttgcaagcaaagtaggattcaaccccacagcagaggtcagaaatgccaataaaaatgaccttctggggtcatttatgggtttcacagctctgatttcaagaggtaccagatatgccaaagaaaatgtggccaaagacctggaaatacgggctcttctgattcagtagggccaggggtcgctgccccagccagaggtcagccaccttggggtcagccaccctggcactgcccagctaagacagtccccacagaacctgagagctggctctccattgtgtctctccagagaaacagccccaacttctgttggttgtctgtacagacttcaaaggaaaaatatcttcctcctatctcatgaaaacattccttgctggggctggacgcagtggctcacacctgtaatcccagcactttgggaggccgaggcgggtggatcacaacgtcaggagattgagaccatcctggctaacacggtgaaaccccatctctactaaacatacaaaaaaattagccgggcctggtgtcgggcgcctgtagtcccagctgctcaagaggctgaggcaggagaatggcatgaacccgggaggtggagcttgcagtgagccgagatcacgccactgcaatccagcctgggcgacagagcgagactccgtctcaaaaaaaaaaaaaaaaaaaaattccttgctgggacataaacccttttcctatcgtcatacttgtccaaactgtgagttcacagccaatgataattggatgcgtggcctctgctgggtagataacctatgccaaactgttttcaaatagacagaaaaccaacattaatatggtttgttgttgttgttttgagacagagtctcactctgtcacccaggctggagtgcagtggcgtgatcacagctcactgcagccttgatctcccaggctcaaacaaccctcccaccttgcctcccaagcagctgggactataggcacacaccaccacattcagctaaattttatttttttagtagagacaaggtctcactatgttgcccaggctggcctgaaactcatgagctcatgtgatcctcctgcctcagcctcccaaactcctggaattacagatgtgagccaccgcgcccagccttagtatgttttaaaagtcaaaagaaaacagtgtactaacagtgacctgaatctgcctgcacttggaggctcaccgttttcacgtgctcacgtatgccatctcctttaagcctcaggtcaagtccatgtcatgctcatttcagcaaaaatgtcaggcagctctccctggcccacagctggctcctggtagggcagtcaaagtcagatctaccagatgccagcacccatgagaaaaggatctggatggtgccaacctaataccccctccatccccagccaccagcagcgccgaggtccttccgtccatgctgtgtgcatggcttttctcatcccctctctgaccccagcagctgggtgagcatcttacagatctccttcccagatcccgtgcaaaatggccagaattctaggtctcaggctgttcatttgtttgatgtgaagttagacttagttaccttggtgttaggagagaacagtgtttaaattatgtgtggcaaggaaaattaatttgagattatgaattccctgcagcgttcaaagagtatcatggagcttaagagcaagttggctgggtctcagtttattgacctggaggaatgtggaaatgctaagggaaagcatggagctgaagagtgctgtgcggactgtcaatccatttccatctgaaatcacactggaaaacagaaaagcctacctatggatctgtgtgggggcatggagaacagtgtgggtggagatgcaaaaagctccacctcagagagctgggagggaagcggagtcagggagggctgcctgcctttttctgtagacattcccctactgattgactggtgacagtgagattttatcacgtttgtaatttccagaaggggaaggcacaatgactggttacagtgagattgtattacatttgtaatttacagaaagggaaacacacaaactgcaagagaaatagatccctagagagcgtggtccaagaaggctgtgtccacatttccacattccctgtggctgaatgcccagactttgagatcaaccccatcaggaagaaagttaaagacagaggctaatcagagtttggcaatgctgagagcttccacgtgccaggtcctgcctgggctctttacctatattacgtcattcagttttcacaacttccccatgaggtgtcatccatgttacaggtgagaaactgaggcacagagacagtagcaatttccctatgatcctaaagtgatcagaggtacagctgggattcccatccaggcatcccaaagcctgagctctctatgttgtgacacttcatagttgtgttgacttttatcaaatcattcaacctctttgagggtcatttttcttatctgtcaaatgaaggtgacaacaacaccttctttttgcaaagattcctttgcaaaaaggaatcttacatatctttatcatatgtatctatatcatcatacatgtacgtatatcatctcgcccagtgcctgcagacaggagactgcagagctatgtgcccaaccaacctcacagggagggcacttttgagtgtgggcaaggtgccatcaaatccactgataagggacagtttagggagtgaggagtgcatgtcccacagcccctctgcatataaggagtgaagaggagggtggtgatgaggtaggacaagggttggaataggagatgagactaagaaaccaggcagctcaggaggctgaggcaggagaatcacttgaacccgggaggcagagcttgcagtgagccaagatcgcgccactgcactccagcctgggtaacagagcgagactccatctcaaaaaaaaaaaaaaaagaaaagaaaaaaaagaaaccaggcaggcacagatggccacgtggagaggtcagcccctgagagggctctggaccacagcctgaacaaagagcacggatgcaggcagctgccttggaggacacagaggatgtctctttgtgtcgcctccatagggcactggtgtctggaagagctcctcggccagccatcacttagatggctggctgactgggttaactttccacccactccctcctccaaccacccagcttgatgttccttcaatacctcttcaacactcatgaggagggacgggagtaaactggttttcttttaataaaaaatattatgcctttctttttaattgcaaagtaaggtttttaaaaataccatttccaaataaaacggttgtgggaggcatagtaaacatttaaaatttacatcatacaatgaattattgattcccagcaaataatactccccactcagtttcagattttcagctgaatgtagcagggcccgagagcctgtgccaggcccagtcctctacatcagggaccagggaacacttggatggggtggggttttatgtgtctctccactgccctcaaaggcactgccaatctcagcaacaggaaggtgctgactcctgactcaccagctctactgcaagtccatcacctgcaaaacctcagtgatttggtccagtgatgtgctactgcccagcactagtggagttggcacgagatagggcccctggcagctgcccagcggcccacccctccattcggctttgatgccatgggagagggctggggccagtgacagtcaagacccatgggcccaggccttcagagtggctcttagcataagggagaagggggtcaaataagggagaaacagcagggaaaattgaaaagacattctaatggctagtggggtggagatggaacaggtaaccaggtctttctggggacagacaggcatgatatgagagatccatccaaggatccgtgtttaactgggacaggtgtgcagcttcgggatgtggggatgaactgtgaagtgaagacagaaagaaaattcgtgcgctgtaacaggctcagtgctctctctaccatatgtcaccataatatttcaatcattagatctgaactaaatacagatttaatttaccaaataacgttttaatgacaacagcagtggcccccagcagcactccaatttacgtacaacttcgagataaattacatcgtttgacttgcgagaaagatgtctaattaggaagatttccagatataaagaactgtcactgtaaggcatgtcatctcatcactctaaagtcactcattaacatatgaaaacattcccgtttaataaactgcttatgtcaaacgaggtcctgaagatgggacgtgggtgaaggtgctgcccagtaggcggctcaactgattcatcacctgatgttatcggccatggccatccctccgccttcagatggagtcgccagatagatatttttgccatacaaggttcttatttcattttatcgtattctgattttctagctgggtatatttcagaattagtatttgtgttaggataagacactaagattctcttgaagcactggtgttttacacagtttatcttaaaggctgcttccaagttgctgcaagataaaactgacttaaggagtctgtcaattagatgcaaccatggtaaccagagaaaactgcaaaatggccataattctgcaactttgccccaaatgaggacaaaaccaccctgtatccaatacaatacatatactgggttttgtagtggcatgaagaaatgccttctgaagttggcccagtttaggaggtatcaggaacgacatctcagtgggtttttgcaggaagaataggagtttgctgataaatttcatgcttcctctgtagacaatggggaagcatcagaggggacgtagcagggtgttgaagtgacaagttctacagcagggagggtggatttggagcagggcagggatgaacagagggccagtgcaggggaggggaccactcagaagaatgctacattcctttcagaccaaatgtgtttgcagcctcactgggaatgctgggttagaccctacaccaaaaactacctggaacaagagctgttctaataatgctaagcatatgtgaaactgtgatgattctaatattggaactttttattttaacagaaaaccaattatcgtaggaagcttctaccatctctcatccaacagtgttagcatgactgttactaatacattgaaaaaataaaaatagataatggagatctggcaaggtggccgaggaaatcacatgtatgagagatgggtggatgaaaaagtcccaaaccccttcaagaagcatccgtgccatttcaagctttccagaacttcagagtcatggactgtctactcctgtttctctgtatcctccccccaaccccagttttaatttccattctattttccctttatccatttactatttcacttatttatgactcaaatatgccaggccccatgggagagctgggacacacagtgaactaactggagccagcaccatctcacactatcactcccgccttccagtgaaggagagaaccaataaccacagggctggttagggaagtacaactgtgccacatactcccaaggagaggccaggtgcctctgaaggcttatagagtagacatgtcctgcccatcacaccttcgtcgtttgtgtcagagctacaactaaaatctagaattcctaatttccaccctactcactctgcctcattcatttttcggtttattcatttgctcattcatttgcttatacctttgttcactgcccattcattctttcaacattcgatcagttattcatccattaattactcacagggcaggccctcttgtctcagctcagctacaaggcacagaggcataacaaggctaatgaacactcacgggtcataaccagggtgctacgggcacattggccagtgaaagctgaactggtctgggcagctcgatgaaggctctgcagaagtggccctgacaagtgctagtgaatcactccacaacatgcaaacctgatcactaacataatatgcaacacacgctcacatgttccaggtgccgcgcagacaggacccctgccccttgaaagtcagagtcaaaagggggagtggcgaggaagcaaaggctgcatcttgtgtcaagcgccgtggaagggaatagtgaagtactcccgggtcttgggggccttctataaagaaggtggtagcatctgggcctggagcctgcaggaaaagaaccgggagaagcaccttacaagcacggagagaaaccgtggaaagttacagaaactgtcaggaggcccgtggcgctggactacaggatattgtcagatgaagtcagcagcttgagcaaagcattgcaggtggaggaaaatttttttaattttttcctatatgtgtcaagaagccactgaaagctttcagacgactttttattgacagaatcctatttacatctttaaagaagtatactggttggaccctcaagcccatagaggggtaatgttgcaagtagaaaagaccaccccttgctctaagtgatgaggcagattccaacccttggccaggccgccatgcagggcagaaggtgccctgattctggctgctgcagaagttgggggatggcaattgaaaccaaagaggtggccatacagatggcgatgaggggacggactgcaggtaacttttgaaggaacagctggtgggatttgtatgtgtatgggcagggaggtgagggaaagggactgctgtgcgttccatgcatcttgattccattatctttgtggccctaatgcaagctttcagctctataggaatgcgaaacaactgcagatttcccatcgggcacatgccagagataagtgcttcccagagattcttggttgttctcagtcttctgcatcacatgccatagtgcgacgaagtctcccttccgatgtacaggtctctctgcaggatcaaattccagaaccgggattcctgagtcaaagcgtgaattaacctataattgtcttaattctgaaaaattatcctcctggggctggttgggggggcattttacactcctcttagcaaaatgtgaaaaggtctgtttcaccccagcctcagtgaaagattatgttctccagcttgtgggtttttgcctgacatggcaggtgacatacaatatcttactgttgttttaattgtaatttctgttaccacgaggttcacagtgttttcatgtgattaggccatttctgtgagctctctgaccccgcccatttttcttttggatatttgtggtctttttcttataaacttctagaatgcaggaactattcacgatctgaattagaaatatttctcccagtttggtactttgcttctaagtttgcatactttcttagaaattttattttatttatttagccacgtaaaagtttttgctttgatatggtcacatttatcaaaatttgatagctgcaaagaatactatatgagctggtaaaaaggaatggggggggtggttcttcggtccagatttagaaagatctccaaatgcattgtgaagtggaaaaagcgaaggtacatattctacccctttttctctgagaaagagaatgtgggcacgtatgttcttatttgtttatattttcataaaggaagtatgataggttattttatatgtcagcttggccaagctatggtgcctggtcatttggttaaacactagtctagatgttgctgtggctgtccttttagatgtaattcatatctacaataaatagactcagttaagcagattaccctccatactgcggggggcctcatccaatcagtcaaaggccctcagagcaaagactgaggttccccaagtagaaggaattcctttcaagactgtgacatagaaagcccagctgagtttccagcctgcagaattcagactcacaaatgaaacctcaacacctacctaacctccagcctccctgctgccctacagatttcaggcctgccagcccccacaatcaggtgagtccattcctttaaaaaaaaaaccaggcgctctctctctctttctctctctttctctctccctctctgtctcttcctctcattggttctgttactctggagaaccctgattaacacgggaacacttggaggattccacaaaaaatgagtacagtaactgtgtgtgggaaggatgagggaggggtggtaatgggaattctcagtttaggccttgttatagttagaaactttaagccgtgtaaatatctcacctactcaaaacagaaagtaaaatttggggcaaaatcaacttttaggtataaaataaaataaatgctctataaattaagcaataaaggttatttgttttatagaaatttaagatacaaaaaaagagaattatccaggtttatccaaaagatgaactgctcaggaagaagacaatttttaaaagcactgagatgcaattcttttaaacatgaacctatataccatatttaaatccatataatattctacaaatctggtgtatcctccaagcatttgatacaaggtttaactctcaccaactcttccactcctgaccccaccaggtgggcaaacataacttgtggcaatctgcaaagaggccaggccacgacctgggctggagtggccagcctgtggctggggagactttccagggaacaggtgccacctccccaaaacgcttcacgctgcgtgcaaggattcagagatgtccagggtaaaccaacactttttaagccaaatctaaatgtttaataaaaactaagaatgatgcataacaagagcttcatcctggaagtacacaccattttacaggaaactcaaaccctaaacatatgtaatcttgtttgtagcagggaacttcctccctgctagattgaagaaaagtattaccatctgggacacattcctctcaccctcagaagaaggggctttatagaagggtctttacttttattagcagcaccctgctatgcacctgctgatgttcataacacatggggctttctgggccactccagtgactgctgagctggcacctgatgacatttcttcaagtaagttgccttagttgacccagctactgctccacaccagaggtggagtggggaggagtgtcctctggtggaaggtcagtgccacagagaaacactgggcactcagactgcattcggtcctgggacagacagcgtgtccccaagcatccacagtgcagcgtccacagagaggcctgactcccaggggctgacagaggcagaggacagagctatttattgaaatgaggagtgccctgctaaaagaaactgcatgcatagcattatagagccaggtaaactcatggtgaggagtctgtgttttggattaaacacgcacgcgcgcagacacacacacacacacacacacacacacacacacacacacgtctgtgtttaatcccagctctattacataactttctggaggttgtttccctttgccaaggctgcctttccctacattaagtgggaacaatataatcccaccataaagaactgtcatgaaatccgaacgcaatgatgaccactaaggctacaagtgcccgtaccgtaggtagtaagtgcttactaaatgctggctcctcctccgtaactgatgggaatattaggagacatataggtctttggatagttcttgaaagctgtctctagaggctgtatttggaaacatatcacatggatcatctcttgaatgaagttcctcgtgacccttaggcctttcaggagtaatgccagggtccttcctgtgagcagctcagccgagtggggctagcggggagcagagatggggctgggacagagcacaagcacagccctggggtggggtagacagggatgctgggcaagcacaccccacctccgctccccgccaaggctgtctgctttctgcaccaaggccccttctacccctgcaagcccacctggccccctgcacacaggagagttgatgcccccagaggaaacaattagggggaatgggaacaaggccccgcatgccctcttcagggggacagttctgggacattctgtacggctccaggcaccccccaggctcacagtggcagccctgataacaccccccagggattccttctcctgccccacatcccccccagctcctcacacctgcttccttgtcctgggctctgcttctgggctaaaaacaaccccagcggggagagctgttaggaatgcaaagaggagaccaaggacttgaggcccctcctatcacctcatttacatccccaggagtgcaggccacactgcccatcaaaagcacgtccccgtgaggcaagatgatgatgatcgcagcggacatttattacctgccagacaccaacctaagcaccttattattaactattttaattctcacaccaattccacaaattactatgagtttgttttccaaaagaggaaactggggcacagagaagctaactttctgaggctgcccagctggtgagcagcagagccaagcatcccgctcggcgaacgagctccagagcccatgcactcaaaggcagaagctgcgctgcacaacgacgccaagaagagaacctggagggtccaggctggcagaaatcagggagggcaagggcaaggaggaagccaaaagctaagaacaaagtcagacaaacgccgaggcagaagccagggaagcagagcatgtcaccaattactggggacatgctctgagagagagggtttgagaactgccactcaccggccggggactgcttgttctaaaggtgcctcaggctgaaatccagctgggcctgtgctccaagccaggagtcctggcacaaaaacacggatctttgctctttctgtccgcagggcctgggatctcagccccaccccaagacagtagaagagaagggacccaggcaggggctgtggtcagtgtagagcctctggtttactagggaagtcaagcctgctggttcccattttctccataaattactcccattaaagtcaaatatccacattaactaaatttttgatatttcacagaatggttccacaaaaagagtactttcatttagctttaaacagccctttctgctgacatccaaattcgtatttcacttccctctcatctttaattaaagcttattatcctctgtgtaaaccaagaagatttatgacattatttagtgagttttctttttttaaattataaataacagtaaacttcagaaaatgctccaatttcacagttatttgttttcaagatttttggccacacactaaagctaaagctaacctccaaaaggcgcaagtcacatcttaaatgaaagctctgatcaaatctagtcctccccagcttctctgggcataaattggaattttaagccataggccaagagttaaaactatagcttctgatttgcttccaatgcgatctgtaactagttattcatggtccaaagaaaagtttggattcatgtcagaaccgcctcatacacacagccatctgaaaagtcccagagaagccctgtttaaatgcaatccaaactgatcctgccatgtttcttctaaaagaaggaaccatttcctgtctcgtgtatggtttcttttcctttctttctttcttttttgagacaagatcttgctttgtcacccaggctagagtgcagcttcaccattatagctcactgtcttgactcatgcagtccttctgcctcagcctcctgaatagctgggactataggcccatgccattgtgcctggctaattttattttattttattttttatagagacaaggtctcgctgtgttgcccaggctggtctccaactcctggcctcgagcaatcctcccaccgcagactcccaaaaagcttggaattacaggtgtcagccaccacgctgagcctatggcatcttaatttttaaatttttcatctcttttcactattttttctacaggagatcattatttcatttaatatagatacccatagtcacaaagagacttaggacttcagaatcagaaaacaaatcaaaaaaatacaatgtcctactacaagaaaatagtttttaccttaaaaaccatggagaaaggaaagtgctaggaaacgatggaccaaagtgattgtgattgaaaagaagataaggggcaactggaacaaagcattcacatgaagtccgtcagcacctagaagggctcatcaggagtctacgcaggctcgccaacacagcagcaactgcaacactcactgctcttttactgacaggatcaaggcatgtagacacggtatctgcgaggcagaggtcaattcagatttttaatttctctcctgcagcccagagccttgtattgggagaccaaacttccattcactgtcatggcattctggagggcacagagagtcaggtgtaacaaatatagaggggcaccatctgggatgggtggggagtattgtcagattctgcgtcagggtgcaaggggtgggcgagcttaccagagtgaggggaaatctataaggaatacatgtccaaccttgcactagagtttgaaaaaacatcaacttttaagtgctgaatcctgaatgcatttattgagtccaaaaatatctgtgtatgtcttcaatgtgtcaggcactgttctcagtttgggcatgcggcagtgaataaaactgtcaagtaaatttcacacagtgagagggcaagaggcttgatacatcatatagggtattagaaggtggtaagtgggggaaatggaaacagggggaggtctaggacagggagcagcaatgttgaacgggtctggcctcactgaaatgtcaacagaacgagaagagggccgcagggctgcagctacgtgaggaacaatgttcccgactcagggagcagtgtggaggcgtgtggctggagctgagctggagaggagaatccaggaagaccggctcgggagtgggaggggtggttgcagatggaggagttggcttttagcctgagagaatgtggagtcttcggagcatttccattacaggagtgacaggatttggaatgagctttgaaaggttcgcaaaagtagctctgaagaagtggggttatgtggcttctgcaatgtgacccgcgatttggcacaaccttgagaactccagccccagtaggaaaatggccaaaggccataaagaagtcacacaagaattcacagaagaatattttcagccccatggtgtcatatgagtaaaaccacacagttccatttcagcaccaggtgggaacctgtctcctataagttaagcggtataaatgaaaatttaatcatgattttccctttcatagaattgtggcctaacttctgaattctgataaaataacttaacattggccaacaagatcactcagcatctgagacctaatttgataaccataactcaaatatctcatcaactgaagttgcaattaacaaaaagtccagttggcagagcagggcctggatgatgaacgattcacagctgatctggggctgccgcctctacggcggtgtcttctttccagaccccccgaaagttcacagactgtcacacatgcacacaactcccgtggccctgcaaaaccagctcccatcaggaaacatgtgggctccttcctgcatggtacagtgaaaagcaaaatcctaacgtacttactcgcattaaaaaaaataaaatgagaagactcagttttatgtctacacaactgcaaaaacaaaacaaaagtcagagatgtgaactccagattgttaacatatctgctgaaacaaacagaacagtttaatcaggaatgtgtacaagctatattgcatacaaattggcatcaatcatgaataaatgaattttggctttttgcatctcatgtatgggacttatttacatggcatactggcaaactggaatgtaaactaacaatataaatgatattgcaatttaggagcatccccaagctgccagaaataggaagaaggcagtgttttggtttcctacagtatggaaaacttatagtgataacccaactaattcatagcaagggggagaagacagcacactaacctttaataaattaataggattgggaggctaaggcaggtggattacctgagctcaggagttcgagaccagcctgggcaacacagtgaaaccccgtctccactaaaatacaaaaaattagcctggcgtggaggcgcgtacctgtagtcccagctacttgggaggctgaggcaggagaattgcttgaacccaggaggcagaggttgcagtgagctgagatagcaccactctgcactccagcgtgggtgacagagcgagactctgtctcaaaataaattaaataaataaaaataataattaattgattaattaattaattggagctgttttcccttttctgcaggtactgaaaaccatcttatgcctgcctataggcatctccatttaagggcttcccacaccctgaaatacaaacactaccaaccaagctataaattatattgctttctactcctgtttctactagctatttctttaaaatttgctaaaatctgcctacaaaactatctaaacttggtgtctattaagaaatagggggatttttcaactctaatttgagttctttaataactatttctgtttgggttttctatttcttcttaagtttggctatattatttataaattaagccatctcatctaaatcttcaaatatattggcataaggttgctgattatcatgtctgaaatctcttgtttatattattttcctttcatatttctccattattcatgtttcttctcttttattgtaatcaataacaggtgtatgtacttataactcttttcaaagaatttttgattgcctctattgcttcttggatatccatttcgttacttttcctttaatcttacttattctttttgtgaatgtatgcatttactttgattaagaatttcaaacagaaatttaagtttatctctggtgtttgtgaaatgtgaaaagtaactgaaaactgcaaaaacaaacaaaaactcctaaagctcccaccaaaagttttgcaataattattaatatttcataagagagggtgggtatggtggctcacgcctgtaatctcagcactttgggaggccgagttgggtggattacctgaggtcaggagtttgagaccagcctagccaacatggtgaaaccctgtctatactaaaaatacaaaaattagctgggcatggtggcgtgcgcctgtaatgccagctacttgggaggctgaggcagggcaatcgcttgacccaggaggcagaggctgcagtgagccaagatcacgccactgcactccagcctgagcaagagtgagactccgtctaaaataaataaataaatatatatataatacacatacatttatacatttcataagagataagagaacacatcaatgcagtcacaagtcacttaatgacaaagatacaatctgagaaatgtgtcattctgagcaatgcaaatggtaacttcatcattgtgcaaacctcagagagtgcactcgcactaacctagatggcatagcctactatacatgcctaggctatatggtgtagcctattgctcctgggctacaaacctgcacagcatgtactgtactaaacactgtaggcaactgtaatgcaatggtaagtatttgtgtatctaagcatatctaaacatagacaaagtgcataaaatgtgatacaataccactgtcctatatgtggtctgtcatcgatggaccattatagacatcattatgcagcacaaaactgtattttattcattccacagatgacatgggagtcttcttatttttgtaatcaataataacaggtgtgtgatcaataataacaggaggagtgatatgctaattaggaactaaggatgtgcaagataaatgtttatactccaagaatgaaacagaaacgaaaaattaaaagtaataacaataagatgattaacaatatcaatagcaactaacagtagtttcttggttacttatcacatgctaggtaatgttctaactatttcatatgaaatttatttattttattttattttgagacagggtctcactctgtcatccaggctggagtgcagtcattgcaatcatagctcactgcagcctcaaactcctgggctcaagcaatcctcccatctcagcctcccaagttgctggcactacaggcacatgccaccacacacagcttttttattttttttttggtagagatggggtagggggtttcactttgttgccaactcttggtctcaagctatcctcctacctccacctcccaaagcactgggattacatgcacgagccaccacgtccaactaattttactttctgtagacagggtcttgctatgttgcccaggcaacaatgtagtggcacaatcataactaactataaccttgaactcctggactcaagcgatcctcccacctcagcctcctgagtagctgtgactacaggtgtgtgcaaccataccgggctaatttttaaattttttgtagtgatgtggtctcactatgttgctcgggctggactctaactcctggcttcaagcaatcctcctgccttggcctcccaaagcactgggattacaggtgtgagccactgcacctggcttcataggaaatttaatcctcaaaagatcccatatagaatgatggaggttaacactgttctccccactttacagatgaaatccccaggaatgaaggcggtgagagctagcaagtgggtggtgtataaggcaaatcattattaatagccacaagcacattacacagagtcttagttttaacttcaatggaagttttattgtttttgacagttgccaaagcagatcagatactgtgattaggtacacggtttcttcctgcttatgaaattacattctgaagcccttcggtctcattccccggctgcctccactctttcttgtaaccgctcgcctgtcacctgtctgatgtgcatcaccagctcattcatcacctggcagatttactaactcactcatcatgcagacactgatgagcctgtccttccgcattcatccccacaccctggctgccgctcactctgacataccgccgcctgtcactgtttgccagccaaaccgatacttttcttaggagctgctattagctcatttgtcagattattttattcctttttgcttatcaacttcccttcagacatcttttagaattttttcttcttgttctcctctgccaaccacttggctcatttgcttatcacctgatattattcacccctcatcattcgacagcttttcagattctattagtcaacatacataatgtgagttctatctcttgtttctattaggttaaacccatacaaatcttgctctgtgccaagtgacttagaatttgcatggggatgacacttacattagagcatattcactatggcacatgaatatcagttataaaactcacattccctttcacaggtcagaaaatgtgggatagcagcagccttttaaaaggtaacacacagcggcatttttttttaatgtttaaaaatatataaataatttattctccccattgcacagaatggcaatatgttctctcctaggtgattgaaaaggtttttgtctttagtctcttatggactggtgcatttgatggggatccagaaaaaaagatgggactaagtgctgcacgcaaaagagaactggccatgaagaggacccacccgccagacaagagccctgtgtgtctgcctgggaaggagaggagctcattcctgaaggtcccacctggacgggctgtttgcttatgaatgtatgcacttaggtaggtaggtaggtaggtaaatgtgtctatgcatgtatacacataagcgtatgaatctatgtctatgggtgtgtgtatgttgcatggaagtacacatgtatgcagcaggctaacactgactgcatttactgtgtgcaagtctctgcaatatgctcccaagacacagtagctcatttagtcattacaacaacctttgcaatagaaataccaatggccacccatattcactggttctcatttgcctggctgtgttctaagccttgccaccacctgggaggtaggttctatcattttcccccatgaaataaatgaatgaactgagcctcacggggatagagttactcacccaatggaggagctcttatgatccccatgttaccagtggggagactgaggcacagagaagttcagaaagtcacttgaggccatacagtaagaaatagagtctgtacccttaagcacatcacactacttcccagtagagaaagatcaccttctgtgatgcttaattttacgagccaacttgacagggctaagaggtacccagagagctggttgagcatcatttctgggtatgtgtgtcagggtgtctccagaagaggctaggatttgaatctgtagactggagtagagaagatcaccctcaccaatgtgggtgcacctcatccagtccactgagggcccacatagaacaaaaaggcagaggaagggcgccgtctctctccccttgagctggaacatccatcttctgtccttggccatcagagcttctgcttctcccaccttcagactccaggacttaacaccagcagctccacccctcctcctgttctcaggccttcgggctctggctgaagcacaccaccagccttccagggtctccagcctggagatggcagattgtgggacttcttggccttcacaagtgcatgaacctattcccatgatcaatgtcctgtataccccattggttctgtttctctggagagtcctcctaatacactttccttttaagaatgtataaaaagacatacatatgtgtacacacattcacagctcaattaagacccttctatcatgagagaatggagacacgttctaagacactaggggatcgggggtgggagagggcctggctccaaaatagatattttgatgaaaccagagtaaattcttagaaattttctgagtctcacggtgataaacagacactgtctctatgaaacacgcacaagtttcaatgatagaaaaggaagagatgagaatagctagcgaccagaaggaaacacaccaagagaaaaggagactgccccaaaacagaaagagagactggaccagttaaaactctgcactggaaatagttaagaccaggccagatactgcaaaaaaagaaaaaactggtaaaaatattttctgtagagcagtattttacatttcccctcattttgctagatttttctgtttgccctccagatccaccatacacctttactgctgcctggaggctgatcttgatgaggcttccctgttttccactgggttcagacttgggcagcactgaggggagactggagtgggcaaggcatggcaactggggtatttgtttcctctctgctggaaaggaccagtgcctgcattctctcaccaaaggccacccctgtctcagggtgaatcctacgaattcaggtctcactccaggccccagagccactccctccctgtgctgttaaggtccaggagccagggcagctctcagctatggctagccctgacagcctcaccatttctgcccctacctttgtaaatagtcaccccattaaactccccattacccaatttaaatatgtcatctgcttcctgctgggatactgagtatgaagtgctccaggcatcccccaggacagagcccctgtatcatgatctgttttataaaccgtggttctggacagtaatttgagtttttaaaggtcccattggcttttttttttttaagcttaaaaaccaaagatgaagtttaaatttgagaagcattcatgagaatgccaaaaaagggacagagtgatacaaataaaaaaaaaaaacctcacacttggaggatcagaagctgagatttaaatgattaataatgcatgcttccagagaagagcccagaacaaatcattctgttctcattatgtagtgaaacttacactggcttcagacctttcctcaaattgctaatgccagaaaaactgattgctcaagaattctgaatctaaccaaattactcttacattgaaagtaacagatggctactttcatttatacactgtgggaaatatatatcacccatgtccccatggtgaagagatgaatgaaaattcagaacgtaagagagctgaagtcagatagtaagcaaatgatggagagtggaatggctgagctaaataaggggtcccacgaagaggaggctttataacctgagttccctatgtaaaattaaaatgtgaagggggttttagatgcacagaataaaaaatgctaatttactcatttttccataaggaaaagatgttaaaattgactttttttgggagtatcacttacctacgaggcaatgttctctgttccaatagcgatggtggtcacccagggacttacatttgctgaagctcattgaactctattcttaaaacaagtgcatcttgttctatgtgaggatgtgaggatgagaagatttttatctttggttttggtaatttgataaatgtagggttgaggatacttttgaaaaatcaacaagatggtctagaagtgaagaagatatgaaatgtatatatatgtgtgtgtgtgtatatatatatatatatatatatatatattttttttttttttttttttttttttttgagacggagtctcgctctgtcgcccaggctggagtgcagtggcgtgatctcagctcactgcaggctctgcctcctgggttcacgccattctcccacctcgcctcccgagtagctgggaccacaggcgaccactaccacacccagctaattttttatatttttagtagagacggggtttcactgtgttagccaggatggtcttgatctcctgacctcgtgatccgcccgcctcggcctcccaaagtgctgagattacaggagtgagccaccgcgcctggcctgaaatgtattttttaaaaacatattgatatagaagttaaaaataaggtaccaaggataagtgcatgagaagatatgcaagtcctctgcagaaaaaatcttaaaactccaatgaaatactctggaaaagaccaaaacaaatggagggatatagtattccatggtcaaggccatttaggatcacacagatgttaattctccctaaaatgatacacagataaaacacaactccaataaacatcccaataagggagtctttcataaaatccaacaagctgattctcaagtctccatggtagagcaaagggccaagaaaagcccagatgcctttggagggaagagaaagctgggggcccttcctcctcacaggtatcttgttgtacaggaactaccaaagcagaccaaaggggcagaactgagtgcctagaaacagacacacagagatacagaaagtgtatttacaacaaagtgggcactgcaggtcatggtaaaaaacagattctagtgccactacaattggtcacgcataaaagaagaaaagagaattcctgtctcacagcatatacaaaatttaattccaagtagattaaaggattaaatgtgaaaagcaacacttctgattctgtaggggagaaaaaaaaagaagcaaatgtttttacaacttcgaggtagggaaggatttcttaataaaagataatcacatacatgcacagaaagtatccccagtgaaggaattaataaattaataaagataaccataagaaaaatgacatggtaagtcaaagcctcggagggggtattttcacatattccaccaagaaatcagcaccagaagatatagtataaataacttttataaattagtaagaaaaagagaaatgacacaaatgggtaaaacacacaaactcacatattacagaagaagaaacacaacataaaactggttgatctcagccaggcgtggtggctcacgcctgtaatcccagcactttgggaggccgaggcgggcagatcacaaggtcgggagatcgagaccatcctgcctaacatggtgaaacctcgtctctactaaaaaatacaaaaaaattagccgggcgtggtggcgggcgcctgtagtcccagctactcgggaggctgaggcaggagaatggcatgaacccgggaggcggagcttgcagtgagccgagatcgtgccactgcactccagcctgggcgacagagcaagagagcgagactctgaaaagaaaagaaaagaaaaaaaaaaaaaactggttgatctcattaggaacaaggagagcaccaactgggactggagatgccgtggcacactcaccagactggcaaacctctcaaggcatgccatgaagaatgcggaacacttggggcacctacatgagtacagttgctttgggaaaaccatgcgacatcatttcatcaatcacactgcccatgacccagcaatttcatgtccaagtgagtgccctggaggaacccatgcctatgtacctgaggagacgggcatttaaacattcacagcaacacaggtcacaggaacaaaatattatatacatggcccatgcagccactgaaggagaacagacaaacatattgtgatctattcacaccatggaagactgcaacaacaatcaaaataattgatgtagagctacacatgaacacgtatgaatcaacaaatatcatggtgaatgaaaaaaagcaagtaatcaaagaacataaagtgcaattccatttacacaaagttcaaaagcaaaagtaagcagtacattatttagggatgtgtacatatgtgtaaaagaatgatgaaccttgaatctctgctctgaagacaggcaggagaccagatgggaaggagcccacaggagggtcctggagtgggcagcttacacttctggtgctggttggtggggccttcaattgcctgcttcatagcaatacatgaatttcattgtacgtgtcatatatttcatgtttaataatattttattaataaatatttcctaatttaaaacagaaaagatgaaatacattttaaacataactgtcagtagaaaaaaaagctagattcctacagtctaaatatttacataaagtaaagcactctcaacgtggtatttatcagaaaaaaaaaccagaataaaagacagaagtgccgaagaaacgtgtaaaaacaagaagataaaaagagtgactgaaacaatccctaaataagtaaagagatttcataataactcaatcccttattttaaacaatttgatttctataagatatgtacctgaaagaaaatgtcagagagaaattaaagaaaaactgatgggcaaagatatcaggcacattcaaactaaaggaaagcaagcccagtgctctaatttaaacaaagccaaattcaagacaataaaacactaaattgagacaagaccactttatattattaaaagatataatctacagggaatgaacagtaatatcccaacatccaaacagagcaaaatgtgacagaaagagccgcagtgaatatgaacatgaatatggatcatgtaggaaaaagctgttatggaaaaaaactgcaaaagctaacagtagctgtgggccagggcagaacacgaaggagtgttttctaagctgtttccctgcattttccaggttttctgtaatacacatctatactcacttatcaggaaaaccataactgtaaagatctgtgttttggtgaggatatcacacgtttaagaaaggcagactcctttcttcctccaaaagtcactgctgaaagtcatgatttttaaaacttctttttttctgaaccccaagacggagtcttgctctgtcccccaggctggagcacagtggcatgatttcagctcactgcaagctccgcctcccgggttcaagcaattctcctgcctcagcctcccaagtagctgggaataggggcatgcaccaccacacccagctaatttttgtatttttagtagaggcggggtttcaccctgttggccaggatggtcttgatctcctgacctcgtgatctgcccacctcagcctcccaaggtgctgggattacaggcgtgagccactgtgctcagccagtttcaatcaattattctatctattgttgaaccacacaaactaaagagcaaaacaaatttgaaacctttgagtcttccttcccttactaatcagaatttttatattttgacaaggaaacatagatctacagcaatttgattaaatacacatgaaaatcagggtaaaataaaattgtttcaacttcatcccactatttattgtatatcataaaattattcaggaatcaaagataaggttcatgaataatattcttcattaaaagagggtggatgtttgaaagaaaatctggtaactaatagcctataaggtagaattttttaaaacctgggtacgtagagagagttcctcagaattgcatattaaattcactttcaattagtatggttcagcattttattctgatgatttatttgtatgcttggtaatactttttaaattaactgtgccacagacagacatatcacatacttcacagttataataattttttctaacgctatatctttataacggtaattgccttctttctgaaagaatacgcattttgaatctagtgacacttcatttattacttttcttatattagagctacctcagcatattagattttttcttaatgacttttttctattaggagaccatgaagaccccagggcaaaggaagtccattaggaaaggggggcattttagaggaggcaggaatttctaaggtagacatcagacaattcttgtcaagaacagactgaacacgagatcctccatttcctgtgaactatagattaattttgatatctgtacaaacaagattatgaaatttgcaatattcatcattaatacagtgaattaaattcctcacatagcaaaacatacatcaagtatgtcactgctcactgcacctcccactctcagttgacacatcaccctgcacagctcctccctggacaactccagctgaccagagtacctgcttataccacgtggaacaggagaccgaggatcctctcaccctgacagctgccttgctctctcctggaacatagcagcaggtgattattcagtgtgggggcaaaaagagtccctatcactcctctggtctgagagccagatgctagagtatgtccaggaagcacttccgagaagctattccctggacaggctgagccgccttggggcagtcacccatctcctgaagccaggagtgctggagcacaggctgagaatgactctgaggctggagagaagactcaacaacctgttggtggctccaccacggctgtccctttctcccaaaactttctacagctcgatttactcctggacccctgcacctggtgcttttcctgcttcctggattttgtcttggttgttctgctggcctgcaaggagtctactctctgatctacccgcccaaactccacccatccaataatatttgggctgaatcccattctcactgtaagattcagtctgaatcagtcttctcctacttcaaccttagtggaagcagcatgacacaatgaaaagagcatgccctctgaaatcagacacacctagactcctccatccaagctttagcaattacccttgtattatgctacccaagtacataatccctttgaaaaggacatgctcttcaaatgcagctgtgaatacttgtcttgggccaatgtataaaaagcaccaggtaggcaccagtttcctcttatctttctaaataaaaattatatacaaaattcatttctcgatttctaacttgcagcaatttcctcccattatcttatacaactttatgtatctttaacattttattgatatttttatttccccaactcatatcataacctcacctagaacctaaacctaaataccatatcttaaccttcttagtttccaagtcattgcacggctcagggccctgtgcaatgcatttcattactgcggcacaacaggctctgagcctcatctcatggcaattctgacgaccactctgtgctcacggtgtgctgatggtgtcctttatgtatccaggacagatagaacaaggaactgctgaccaggcaggttacagaatcagcccagggttagacacttacaggtccaatggggaagcaccccaggaaacatgtaacaaagcctccattagcagcagctggacaaattcttcccctcttctggaaacatccttaagctttgctgatgcccacacctggggatactaagtggtttattgtaatcaagaaatgtatcatggtcttggggtccagctacatgcaactcacttcacagcacattaaccaacagacacggatcacaggaaaatcactccagccataaagaaacacacagactctgggactccatccagaggcacatcccagggcttctgagctcccagagacggcccccactcagtgctgttccacagaccttaccacccactcagtctctaccttcacaggaagagagtaacattacccagacagggctatgagaataactcactctttctcagaagcttctcagccagtcagaagcagcaatcagggaaaagttgattacaattgtttccaggtgaattcaagatgatgcatttaattatgatttttgagcacataattaccttattgggtatctttgtctaccttgtttttaatctttttttttttttttttttttttttgagacagagtcttgctctgtcacccaggctagaatgcagtggcgcgatctcggctcactgcaacttccgcctcccgggttcaagagattctcctgcctcagcctccagagtagctgggactagaggcacacgccgccacacccagctaattttttgtattttagtagagaaagggttttaccatgttacccaggctagtcttgaactcctgagctcaggcaatacgcccgcctcggcctcccaaagtgctaggattacaggcatgagccaccgcgtccggccccttgtttttcatctttctattctagctcgctgtcacttgcaaaaagttaagtttttatatattttcaataaaaaatgtgcctgatggattaaaagagtttatacttccaagtgaagtgacttaagcaaataaaaataattgtcatgtttcaataaaaattagtattttatcaacaactatttttaatttcacttggtcttgagtggtttccttatgttatactttagtctgtttcagtctcgtttttctggttagactatctttccctgctgatatttaatactgttagtaaatttaaaagaagcgtattagtccattttcataaacgaggtgggaggttgggatacttaagctgctttatgagcacagcaaaattctgcattgttttaaggatctgtacaaatatgttttcaccctacttccttcttttcttctgcacttaataaatgaaagcttcatctttaatgtgaccaagcaaaatacattctcttaaaaaaaaaggtcacgaccttgactgtaagaaatccccaaagtggatttataatgaattttccgaataaataatgactccaaatacatttacattaaaaatattaacctttaactcacctatatttttaatagcatataaagtgatatttgagctcaattcatggcttcgaaagaaagccttgcaggctttctataactcatattaaaggttaagatgattcataaatttttttccacagaatatggcaaacagatgactttgtagtgtgactgggactgaatttctgatgggcacagcaggaaacatttctgtaagtgcaaaaattcaaagacacttttgaaaagaagttaatatatgcagcgtaagattttaagctttcttacattgaaaaatgatcagcatagcaatgaagagagagaaataaaaaaaccactaatccaggctgaagttcattcatcacacacttccaattccttgatatctgcatgttacattaaatactgcagtggagaaaaacaaaaataagagaatccaactagaatggaaagacaatcaaagctatttttcttcaacagttgtctataagtttccaataaaattggggctatgacaagaatcgagcatttatacttatgcataaagtaagggctggtttctctaatagggctaattatcggacacctattaccaccactccggggacagcatcaatgaatcaaactccacaggactagaaatattctgactagtgtccaggataacaggagagctaccagggcttttggtgccacacacctgggtttattagggccagaattgctctccataacctaagaaccacccaaacatccgcaggataaatgcaaaaccctgggaaccctcttttttttgagagaagaaatatggaaggaaaaaaactttcctctattttgtagcttctaattaaaaggaatccatgaaagaattaattgcacctaaacgtattttactacgtcttacgttgtactgcagtaagtcttaagatgagctgcagaggggaatggattatgccttactaaggcatggaaagaggtttttttggttatattttaaggtctcaggtaaggcactgattaagagccagttggcctgggctggaaacctgcccaccacttgcctgccacacacctgccctgtgcctcagcttctcttttggctaggatgataacagagttgtctcactggggtgtcataagaagtaagtgcagcaggcatctatctgaacagggcccagcatatagcagtttcccaccacgcttgttattgtggaaggtacacagaaatggtcggatttctctgctgtgacgtccttccattcagctctcttgcggtaaaacgcttcagtctaagtgccttccttcacccagctgaaaggcagaacacttactcccgttttggataacagtgcaagctgtgagtcataactggtgtgggagacagagatagatcatgcctttccctattgttagtcatttcaaataaactgaatgtatcctggtttgggggtgatgcctttaaaaattttttttaatttaaaatttttttagttgactttatttttagaacagttttaggttcacagcaaaagttagcaaaaggtacagagagtcccatacactccctccctccccagaggcacagcctccgccactaccaccagccgccagcagagtggtgcatttgttaacaactggtgaacctacattgccacaccattatcactcagagtccatggtttacattagggtccactcttggtgttgtacattctatgggtttggagaaatgcataatgacctgtatccaccattatattatacagaatagtttcactgccctgaaaatcctctgtgttccacctcttcatccctctttcccaacctgtgacaaccacttatcttattactgcctccacagttttgccttttccagaatgtcatatggttggaactatacagtctatagccttttcagattgacttctttcacactgtattatgcaaagtttcttccatgtcttttcatggctaaatagctcatttcttttttttttttttctttttgggacagagtcttgctctgttgcccaggctggagtgcagttgtgtgaaatcggctcactgcaacctccacctcctgatttcaagagatccttccatctcagcctcccaaatagctgggattacaggtgcccgccaccatgcccagctaatttttgtatttttagtagagatgggatttcaccacattggccaggctagtctcaaactcctgacctcaagtgatccacctgcctcggctcccaaagtgctgggattacaagctcatttctttttagcactgactaatattctattgtctaatgtaccacagttacatatccattcacctagtaaagaacaaggttgcgctttttttaccccactgctctgggaatatagtttccaaaaattataaaaaaaaatacagagccgcttttagtatttctgaaggctgctctgatttgtctttgtcctttaaaagtctgcagaaaaaaaaaacaaaactgaatctaataaaggtgcttctgacatttctgcaacctaaacacgctttacttggtatcttccgtaccctcacaccagaagacgacacctttgttggttctgtttgttaaagactcagaagccagggccccagcaccacccagcaaccccccgaatcaaggtgcagcagaacccagcattcacgctgaaacacgtgtcctgtgctctgatgtagacccaaatctaacagccattgacatggactgttagatgacttccgttatcacctactgggataaaacctattttgttttggctaataaatactgttctatgtcattactattattattattttcgagatgaagtcttgctctgtcacctagtctggagtgcagtagcatgatcttgattcactgcaacctccgcctcccaggttcaagcgattctcctgcctcagcctcctgagtagctgggactacaggttcatgccaccaggcctggctaattttttgtatttttagtagagacagggtttcaccatattggccaggctggtctcaaactcctggtctcaggtgatccacccgcctcggcctcccaaactgctgggattacaggcgtgagccactgcatccgaccttcattaaatttaatgtattatttaaactaggatttttttatcagctttattgaagtataatttacataaaagaaaacccaaccatttaaaatgcacggttcctgacaaagtacagcctgataaactcatatggccatggaagcaccaccgcaattaaactacagaacattccatgtccccagagtttcccttgtgcttccctgtagccattctcttcccacaccccagcgccaggtgaccactcatctctcctccatcactagaatttcagaaaaatggaatcatacagtatgcagtcttttgtgtctggcttcttctatttagccatttgcttctgagattcacccacattacatgtatcaacaaggagaatctttttaaccccagaaatactctggctggaaagtagaaaactattcagcaaaagctactgtagaaaaacactccaagatgattaagaactgtattccacccctctcaaataagacccttgaacaacaagtgattcctattttaggacagcaaggagattgccaagtgatggatacaatgtatttattttttaaatatcttgctagctaaagacctttaaagatatttggagagagatgacatcagaaaaagtggcaaagacctaaaaattcactcctccataagaggaaaaaataactgaatgaaatggttagaatcaagttgctcataactctggaaattaaccaaaggcctgcagcaaccttggaagcatttcttcaagatgaagagctgaatctcggtaagaacagtaggatttggggcattttggcttgccctagtcccatcctccattcctcatctctacagtacccttgaaaaataaaagctcacatgcctggtgcagcctggaagccacttgagggaagggaacaaagctggatcttttccaaagtcccattcccaaataattctcatgatgtgaccattctggtgattccctagaagaccatacttacaaacctagttatatttgacctgaccctgagctcacccagtgtgaacagtcttttccctgggggtgactgtcaaatacatttgtaggcaagtgttttcactttgcagctgcctaatcagtagataatagttggggcaaacaatatattaatctaaacacttaaaaaaaatcctggggaataagatgcccatagcacttttgaaacgccccaatatatctctgggaatacagagtgccacatgcatgcatagcgctgtgcatatgcccaggaaagccctgagaaggctctaagctctcagatgacaactgccttgcagaatgtggaaggtgtgccccaagagtcacacagacccccttgtcaaagactgggagatgtactggctccaggcatttaaagaaatctctgtccaataactaggtaactcctaaactaacttggtagacaattcagtagccacacatgacaaagaataggctttacagaattcattcagaaaagtcatcaacaataaactatagtggacaagaagaatttgctttctagaggcaccacattatattagtgaaaatgcccagttttcaacaaaaaaaaaaaaagagaaatatgaagatacaagaaagcatggcccatattcaggcaaaaaaaaaaaaaaaagcaatcaatgtaagtgatccctggcctggcacagtggctcatgcctataatcccagcactttgggaggctgaagtggggagatcactcttgaggtcaggagtttgagacctgtctggctgacatggtgaaactccgtctctaccaaaaatacaaaaattagctgggcatggtggcacatgcctgtaattccagctactcaggaggctgaggcacgagaactgtttgaactctgccaggaggcaaggctgcagtgagctgagatcatggcactgcactccagcctgggcagcagattaagactccatctcaaaaaaaaaaatatatatatatatatctagctcacatatacatctcatacacacacatatatatacacacatacacacacacacatatatgacccctgagaaaggcatggtggacttagaagacaaagactttaaatcagttatttaaacgtattaaaagaactaaagcaaactgtctaaagaactaaagaaaaagatgacaatgatatctcaccaaacagaaaatattaatgaagagatagaaattataagaaccaaatagggctgggcatggttgctcatacctgtaatcccagcaatttgggagactgaggcaggaggactgcttgaggccaggagtttgagaccagcctgggcaacatagcaagatactatcattaacaaaaaaaatacacaaaaattagccaggtgtggtagcactcacctgtaatctcagctactcaggaggctgaggcaggagggagaatcccctgggcccaaaagttcaaagctgcagtgagctatgatcataccactgcactctagcctgagagacagaacaagactctgtctgaaaaaaaaaataaccaaatagaaattatagattgaaaagtacgataactcaaataaaaaactctctataggggttaaagagcagatttgagtagaccaaagaaagagtcatcagttaacctaaagataggttaattgaggttatccagcctgagcagcagaataaacaatgaagaaaaatgaacagatcctaagaagtgtgtgagccatcataaagtgtaccaaagtgcatgcaatggagtatatcaacaggagaggagagaaagtgaaaagggcagaaaatacctttgaagaaactatggccaaagacttcccaaatttgatgaaagacaacaatctacacatccaagctgaatgaaatctgagtagaataaactcaaagagatccatgcctagacatatcataaacaaactgtcaaaagccaaggccaaagagagaagcttgaaggcaaaagatcagtgacttaccacatacaaggggtccaaataagattaacagctagtttctcattagaaaacatgcaggacaggaggcagagcaaatggcaagaaaaaaaaaagtgtaaaccaagaatttcatatccagcaaaactatccctcgaaaatgaagaaaaaatcaagacattaccagataagccaatgctgagataatttgtctctatggaatctgccctaaaacaaatagtaaaggaagtcttttaggctgaaattaaacacacacacacacacacacacacccaggtgcacgagcgtgtgcaaaactagatagacagtaaattaaactcacatagacataaaaagcatgattaaagataactacatggatgctatggtttggatgtggtttgtcccagtcaaaactcaggttgaaatttaattgccaatgcaacagtgtttggaggtggtgtctttaagaaatgattaacttaagttggattaatgtctttctcacaagactgggttagttctctgcagaaaggattagttttgataagagttaattgttataaaatgaggttgcctctcacgtttttccctttttgcctttccctttatctgccatgtttggaggaagcacaaggccctcaccagaagcaggagatgcgattgtccaatcttgaacatcccagcctgcagaaccatgagctaaataaacctatttttttaaataaattacccaatctcagatattctgttatggcaacatacaacaaaaggtaagacatacagaaaacaaatagcatactgggagacataataattcctcatcagcaattacattaaaaaattaaactctccaattaaaaggcagaaatttcagaatggattttaaaaacatgatccaattacacactgtctataagagattcactagagtttgtcagtaaaaagtagaaaataatatactgtgcaaatgctaaccaaaagaagtttgagtaactatcctagtattagacaaaatcatctttaagacaaaaattgttactagaaacaaataaggacattttataatgataaaggcttaatcattcaagaatacagaacaattatagacatatttgtacataacaattgtgccagagtagcaaagaattagcaaagaacaacattctgaacagctgagctggtagctctatactgaaaaatgagaaatgtcatttgcctaaattattgacaaccggaagactgcaaccgagatcaagtgcaccctagaaagccacaggttttctatcctggctgcatattgaaatgatccacagagtctaaaactatagataccccggccctatgccaagaaatcctgatatagtgagtctgaagtaacatttcttaaagtgccccaggtgttctgaagtgcaggcaggataaggagacacgggcctagagtgtgagagcatgggctctgaaacatacagcctgggtttcaacctgagctctgcctcttactcgctccaaaaaaccttgaacatgactgaaccttgctgtacccacatcatggaagagtgtctggaacacatcatagaagacactaagaacagatttaaaaaaaaaactatcccagtaatgtgaaaatacatattctttattcatgtcgctagttttcagcatttagaaaggcacttataaatgttagccattactgtcgttgtcatcatcatcatcatcatcatctgtcatcatcatcatttgcccaggacaggcacaacttgaggtacctctgaaccctcacaatggacactgaagttggggaagaaagagacaaatggcagctttacctggtggaaaataagctcagctcttccctcttgagcctgcttcatcccccaggaagactaaagtggatcttgccagtcagcacaacagagctcccactttcaaagatggccttcacattctggaccacgcatactagggtggagtttaggaaaggtaaactgtgccaccctcccataccaccacacccccgcaaacacacacacacacacacacacacacacacacacacgaaaccaactaatccaacaacaccaactttctaccttcattaacatagtccttcttttgtaaatataaataggacaatgaaagatggcctgatattgagtgggaaaaaaatagcataaataatgacctagatgattaaagagaccagttaacctgtggggggaggtgagaatatctgataaacagaattctaattaatatacttgaaggagattgcacccattaaatgagtgtttcataaaatgtgaacatattgctatgaaaaaaagcaattagagaaaaacacagttcttagaaaataacataactgtctgtcaaaataaaaaattcaacagaatgatcaaacagtagaatggatacagctgaaatccaaagtagttatctagaaaataaaatagaagtgccccagaaagtaaagaaaaagagaaagaaaacattagaaaatgttaagaatcccataggatcaatttagaaggtagagcatctatccactaggaattcaagtaagagaaggcaaaaataaataaatagatagatagatagatagatagatagatagatagataaagagatacaatcaaagaattaatggaagaaatttccccaacaatttttcttgaactatccaatagacgaataactagaactagtttaataattcactatggtctgtgataaacaagtatgagatcaatacacataatttttccagaaattatggcagaaaatacagttggttcttgaacaacacaggtttggactgcataggtccacttacacatggatcttcttctacctctgccacccctgagacagcaagaccaacccctcctcttcctcctcctcctcagcctactcaactgatgacgatgaggacgaaggcctttatgatggtccacttccacttaattaatagtaaatacattttctatttcttaggactttttgaaatgatattttcttttctctagcttactttattgtaagaatacagcatataatacatctaacatacaaaatatgtgttagttgactatgtgatcagtaaggcttccagtcggcagttgcttacttgtagttaagtttttgaggagtcacacattatatgcaaattttcaactacatgaggggtcagtgcccctaactgccatgttgttcaagggttaactctatatccccatctctaaatattatagatattattttccaggaattaatctataaaatcaatgcaatcacaaaatcaaatcatggccactgtgtaactttacaaactcattctaaatttattgaagaatgcacagaagagcaaataatatgtgaaaataagtcatttgacttattataaagctggactagttaaaacaatgtagtgttgtcttagaaatgaactgatagattcattacacaaaataaagattaacaaacagacccatatctagcagtgaggtggtggaaaacatttcaaatggcaggagaaatactgaatcgttcaaaaaaaataatattgggaaaatggtcatccgttaggaaaagataaagttagagtcttcataccatatgtaaaaataagctttgattcaattaaacataaaaagaaaaattaaacattttagaaataaacaggtgaataatttcagaattatggtccaagagagatcttttacagtgtatattttaaaaagacactttgttaaaaattaaaagacaaacaaactgacaagacaaactgggataaaatattagtcacttaaaacagaaaagtattatgatcttaagaaaaataaaaagaaaaaataaaaataaaaataaggaaatgaggagaggtcccctccaaggagggacagtgacagtgaaggagaggagtgatttgaaagactagaaggtaagaaaatgacatattaataatttggttcaatatattgaatcaggtcggggtgaggaaggaaccaagggaacctgagtttaggttttagaataaggcaactgaaggaaagggagaaacattcctaatgagataggggagcaaaaagaaattagtttgggtttggagtagattgagttggggtccttgtaggataaatgctaacatggaggctcctccagtttagtctcactaggcagattcatttgagttaacaaaaaactaaactatagacctcatgtgaaaaattataagattgtgttgtgtttctgttttgctttcttttcattctctttattatttttttattttgctttcttttatttttatttttattgtctcctacttgagttgctttattgaatcttcttttgtagacaaataagaatcatataattgtttggatttaaatggttattttcaaattgcttaagggtattcgaaaacaacttctttccttgcaatttttaaaatgtccctttctaattgcttacatgttaatacagtcacacaacaaaataatatgcaactgtttaaaacagtttgtactaagaaatattagtgaatggagcaacagtcatgaaatactcctaagcagaaaaaaaaaggcaggttacaaaataggtgcactatgaatctaattttcataaaaatatgtacgcatctgtgtatgcatggggaaaaatggaaggcaaaacagcaaaatataattgtctatctctaagtgttgggatctgggatgatttttaaaaattgtcttgtgtttttatgcatttgctaaattcaaaacaatgaatatttaatatactagagtttaaaaattaaaaaaaagaaatctcacacatcaatgtaacacagtctcacagaaaaaatatgtacaagcaattcatggaagaaattcaaataggtaatggaatcttattctttgtttcgtttcggtcccatctattctttgtttcctttttcctgttttctgccttcttttgcattaattggatattttttattattccattccatttcctttgttggtttcttagccaactctttggggtttttggttttattttgtggttgctttaagctttacagtatacaactttaatttatcatagtttaccttcaggtgacattagacttcatcaagtatagtctaagaatcttacattgtatagttccatccgccctcctttacagtattttcacacaattacttattcaaatgttataaaccccacaatacattggtgcatttttttttcctatttttggttctttgcatgcattcagcttcttgaatctgtgggtttctagtttttattccattttgaaaaaaaattactactatttcttcaagtattttttctgtttgccctcactccttattccacatatattagtgtttctggaaattattccacaaagctctgtgatttttttccatatttttgttgaaaaaatgttttttctctgtgttcttcattttggagaatgtatattgcattgcaatgcctgtaagtccactaatcttttttcttgtctcaaatctgccattaatctcatccagtgaatttttttctctcttacattgtagttttcatcagtagaagttcaactgggttttttttatacctccatgtgtctacttaacttttggaacatacaattttaataactgtaatctttgattagatgatagacattaggaatgttatctagttggtgctggatacttttgtattcctatgaacgttctcaaactttgctctgggacacaggtaaattacttggaaactatctgattcctttggatcttgcttttaatatctgttaggcagaactggaacagcatttagctcaaggctagttattctccactactgaggtaaaactcttctgcatgctgtatacaatgcccaggtgaatcatgaggtttccaatctggatggtgggaaaaccctaattttgtgactggcacttttgtctctagtcctctcagatagttctttcatggcctcagtttctctacctacatgcaagagctgatcagtagcagctgaatattcacagggcttcctctccaaatctccagaaccctctacttgagtaagtctttcctctctggcactttgttctgcaaattctagccaccttggactcccaggctcagtatagcctccttaactcagcaggactgccaggctcttcccaggttcctgtgctgtggcctagaaaccttctcacaacaggaggctgcagcaatccatccccagaggatccagaggcacacctttctctacagttatgagaaataaatacgcgagaggaacctcagcatccctgaactcttcctggaggccacaaattacagttggaatttctgtgctgccatctaactagggtccctaaatgcaatgaagatgatgagaccccagggttgcaggggccaggtggcagctcttaattgccaaaggcatggtggatgtggttactgtgaagcacagagagccaaagcagccatcagagtagactggctcaccgagatctttggtgttggctctgaaaagccctgtttctctgattgagccgtgatggatacacgtttctgtctgggttgataaagcttagcaataaaaataaaccaccatctgagtaaggcaaaaagccagatccctcaaacaatgtaatataaaatgcaaacaatactaaacacattattggatctatatggtactcatattcccatagattagtgcttcttaaagtagatttactttgctttaaaaaaaaaaactgtcctaaactgtaactaatttgttattggtaaaaataaattctaaaaaatgttttcaactccatggttattagtttctcaacagtattagttattatgaataatctaatatccagttcagtgctactgtactcaaggttttaaaacttataccgcctgtgattgtgggagactgtttccattattcatacataagccatcacaagatggttcactgaatctttcaaaaaatcatctaatcagagctatataatctgatttctaattggcatccagcataatatagaacccgttatagtttaatgtaaggaagacaatgatctcaatcatagaagacactaagaacagatttaaaaaaaaaactatcccagtaatgtgaaaatacatattctttattcatgtcgctagttttcagcatttagaaaggcacttataaaacactatggtaaacacacacacacacacacacacacacacacacacagcatttcccttcttcccctccgacattgcattcgccagcctacaaagggaggcctccctcactgagtgctcacagtgagctgctgctcccctctctttgccctcccgcacatcagtcactccggcagggactgtacagctctccttcatctcgctctgtgtgtctgtaagcgcagaatgatgaaaagaaggagctgcagcagggctccggatggccttgtgcttgggagccctgcagaggaaagctgctgccaggagagcaatggcagcaccaaaacgctccagcagcaggggccactcatgcctgtactcagccagccaggcctgcagggcgaatggagtggctgcaaagaccttggagctgtgggcccaaaactgcttcttctcactatcctgagggatacgcccctttcagagagggcaactgactgtgtggtgtttatggaaggagttggggggagggcaggccagtgtgcccccctgggaatgaactagaaaactcactgctgcatctttagttgacacctccaggaagaaaaaaaaacaaatcattagcacagacaataaaagcaggagcttttattttaaaaatcattgaaatcaagacttcaagtcatgctagtgctaagtcccagggcagggtactttgctttctaggtcttcctttccttgcataaggtctcacacgtcatctggaaaacctcagttccattttgtggtccctgggaaaccatgaagggcttaacgaaggggagtgacacaggctggcagacactttacataccacccacggcatctgtgtgtgtgtggagaacggattggagaagagccagctttttggcacacagatctgttaggaggctactatatgagatgccaggcaaggacctgccctagaatggtggctcaaggcagagagaagacaggggcagctgcatacaaataaaatgagtcacggccaggcgcagtggcttacacctgtaattccagcactttgggaggccaaggtgggcggatcacgagatcaggagtttgagaccagcctgaccaacatggagaaaccctgtctctactgaaaatacaaaaattagctgggcgtggtgcgcacacctttaatcccagctactcaggcagctgaggcaagagaatcgcttgaacccgggtggcagaggttgcagtgagccaagatcgtaccattgccctccagcctgggcaacagagtgagactctgtctcaaaaataataataataataataataataataataataataataaaaaaatgagccacaaggagagagcttgtgaataagtatgatgggtgaggaaggagaaggatgtctgagtgtctccccagtttctagaatgggtaggcggtggtgtcatcaactgagacagaaaatacaaagggacaagaagatgaggttgaaggaatgtaagtcatgtgatacctaattagagaagaaagataatgtccacacagactacagttggctggaacaaaggaggatttgggagtcagagaggtttgggttcaagtcctagctcattacttaaggtgtggaagccttggcctcgctttaaaaaccttttttaaaaaaactcttttgaactttaaaaactcttaaaaaaaaaaaagagtaggaaaacctactcttgccaggactgttgtgaggataaggacatacaggtcccactcgatgaatggttaccatcattgtttacagtattttctttggtattattctggatagaacatctttggtcacatttccaaaactctgcggtgatggttcctgatggttccttagtcaactcggctagaccacagtacccagatatgtggtcaaacactagtttggatgttgctgtgaaagtatttttgtagatgagattaagttttaagtagaccttgaacaaagcagattaccctccataatgtagtgggctgcaaccagtcagtggaaagaagagaaaatgacggacctgctacagggaggagggaattccacctgctgcctcccttcaggctaaagctgcagcctcagctcttccctccatctccagcctgcgggccagcactgcagactttcgaattgcccgttcccacaactgcgtgagccaattctttaaaataaataaatctgtctatatacatatacatacatatataaaatttataacctagatatatatatacatctgtgtatgcgtgtgtatatctatctatatctgcctctatatctgtatatctcccattggttatgtttttctaaagcaccctaatagaactttatattgtagattttccttgcatctattgtgaatgcctttactcctcataaagccaaagccgaggctatctcaatggtcatgattcagagagtgagtttttgctaatgaaccaaaagattgcactgttgtggtcaacacagcagaagaacattctcatggtacagataaaaaactacccagcaaaatccatacacttccgtctgcagtgcagaactgcctctgggaagtgcctgtccagagaggcagtgcctgccacaggttcctagatgggcctcatgacaggctctcctgaatggcttgaaaggcaagcaatgaatgtcagtttcaggccaagaaaattaaactgctagggttccttttctgttctctattccctttcactgacttgccaggtccctgagcccctctgtgaagcctgccacaggccacgcctgacctggacaggggccagggtagccttgccctgaactgagccactgatagtcaggaggttgctccagcaattagtgtcaccctaatgataccctaacctccctacataaggcaaggaagtcagtcaagccacatgaaccccttctcctctgcctggggcttgggaagaaattagtccatggaaggtcagtgctgaccacctcccagagagcagactggccctgctccaactatgcggcagggctggggagcgagcactctgaacattctactcctgtaggtccagctgctgctacatccccccactgggatgagtcctgagaccccagcctgcttccctggcttccctgggacactcctcagccaccaccataaggggtcctaactcctcgtcagctataagcttatgcatcctgcatggtaaaatgcccagccctgtgagattcctgatgctgaggccagggctgggggtggcgcgcgggggtgattgggtgatggacgtcatttctctcttgtcttttcattcacacacccactctgcggaaggcggcttttcctttgtttagagagcttaatctgtctgcaccatgaaggtgggtgtggagtgaggaggcagctgtccccatgtcactgaaggcagcgcagtcaccacactgcataccccgaggatgtcaaccccacagtcagcctattcactgcatttccccttggcaccaagagccagcttcaaaataatccagcaaggggctggggggaggtggggggtggggagatagtgacaaaacaagatgggccagatgttggcatctgttgaagccagaagaggagtacacaggggttcatgacagcagtctgtttacttttacgtatgtttgaaaagttctaaataaaaatatttttctaaaaggaaattccttatatgagccgagatacagcagaagaggagcctcacctgactctaaggccactcctgtcttccctgataccatttcagggcgtcatggttactctcatgaaggaagaggtgtttttaatagacaaatgtgggttatttttctattcccattaatatttactacatgtcattatctccaagtctaatcacttaaagaggagattttaaataattgattaatataaaagaagaaaaatgccacgctgtctttttcattatctatcaaaacccagaaaacctcttcctctagtcctgacacagacacatacatatattaatgcatacactgagaagaacaggcatacaaatcaatagacacaaatctgctcagggcatttttccgagggaaaaaccattaacctctctccatctcccgcgtggcctgctcctcagcacaatgccacggcaattcaagtaactctttttattttactcacagaattttagggttcccccaaaaacacaaaaatctaacatttcttgaactctgataacatatattttgcttgtgcgatcatacatatgcatgtatagtgcataaacaggctttaatgtctagatgaaatgcatgcatccacacttttttttttttttttttgagatggattctctctctgcaccaggctggagtgcagtggtgtggcgcgatctcggctcactgcaacctctacctcccgggttcaagcaattctcctgcctcagtctccccagtagctgggattacagacacccgccaacattccccggctaatttttctaattttagtagagatggggtttcaccatgttggccaggctggtctcgagctcctgactcattatctgcccgcctcggcaccccaaagtgctgggattacaggcgtcagctgcgccaagccgcatccacacttttaaaatgcccttgttggccaggcgcagtggctcatgcctgtaatcccagcactttgggaggccaaggtgggtggatcacgagttcaggagttccagaccagcctggccaagatggtgaaaccccatctctactaaaaacacaaaaaaattagccgggcatggtggcaggcacctgtaattccagctattcaggaggctgaggcagagaatcatttgaacctgggaggcagaggttgcagtgagccgagatcatgccattgcactccaggctaggtgacagagcgagactctgtctcaaaaaaaaaaaaaaaaaaaaaaaaagcccttggttcacgctcggtccttacaggaggacagcaaaacaaaacaaacacaaagaggatgccctcggagcatctcagcaagacactgaggagcgctctcagaagcacctcccatgagaaacacagtgcttctcacaagcccatcagcattcagcagtgagattttatcaagctctgcttcccgctgcctgaaaagaagttggaattctcttcgccactgcctccaacctgctcacgcatctgaaggtggaaccctgctccaaggccacctggagacgcaggtgccacttaccacaagggagagaggcctcttccaggagacgacacctatgagtcccgacagcagcacctggaaggacaaaagatacaggaaggtgagatgcttccgaaaccttgcatgggcaatcaaaacactgtgaaccgtttcaacccggagaaggacgtgtggaacacagcacacacacagtggcggggctaccatgagctgcattttcacagcttgcacccactctgagaggcacattggtctctcagggcaccagggtgctatggaggggtcactttgtgcactgcactaggtggcccgagagtgacaggctttctgaaacaccccaccctggtcctcgatgtgatttggctgtgctaggcacacgcttgtattcctagctactcgggaggctgaggcacgagaatcacttgaacctgggaggcagaggttgcagtgagccaagatcacaccactgcactccagcctgggaggcagagcgagactccatctcaaaaaaaaaaaaaaaatcacagagaacactatttggggaaaaggcaaatgcaaccccacccacgggccacctggccacctgccatggttgcatggaccctgggcatggcagaccctgcaggctccttctgccctatacacacttggctcccctgatgcacacccttctctcccctccagcccctgcgagcccctccccttcactcatcacagcttcccacctcacccgtacataggcagtgtcttctgatgaggctccagaactttctaggccctgactccaagcagcccactcctttcccaggccaagtcctgcccttgaccttgcctggggtctcaccagaagtcatcccctctctcctgcctcctccctactgtcctgatcacatgaatacactgtgacttctgtcccttagaagaaccactgcttagccctgtgtccagctcctggcctgcctgtctcctaggcggcctcctgaggccaggcaacctgaggatgacactggctctgatccccacattcctgatttcctggtgtccaggaagggccaatggatcatgaagacacagtcacttcccacccactaccatctatctggcttcagccccacaactccaaggaaacttctcccaaggttccccagcagtcaccaagtgcgacagacaaagctcggtccccatcacccggctgagggctgaggctccctcccatctgggctcctgtggcttctcactcccctgcggttcttcccacttcccaggggccgctctcctccacagcctccctcctggcctcctccctctccccaacctcttcctggtttcccaacacctgtctcctgagccctttgtctcctctccccagggctctgtggtggctgtcctgaggctcctcgagtaccatccactggtatctgcacaggtgattctcagcccagggctttgccatggccacggcatcacaccgtccacaggctctgctcctggcatctgtccaacccaacatgtccaaaaatgcagctgcagcctccacctcagaagcccacacttcctcttgcaacctctgctctccacaagagtacctcttcttccccgtcactcaagccgaaatcctggagatctttccctctcccttacccccatgtccaaccagggaggaacaggaggctaaggctcactcaacagggcagcatgtgagaaggccgaattaaaaggaaggtgtttgcagaccaggtctcctgtgaagacaaattgctcacgcttgccactgtgggcacaagccaggcatccgggcactggctggaagggcttggctgcatgtcccctgagactccaaaagcactggccagacccgggaggagggcatgatgctgacaaactcacaaggtacccttggtcacagactgcagttcaccctcaaccacctccacagggggcagaaccaggtctcagacacagcagccactatcacatcctgcaccatgctagtctagtatcaaaaacatctggccacaaaacaacaaaacaacaacaaaaacatgaaccaaagcacgcacaccagggctctgctcccaagcctctcacacgtgtattttttctgcaacgctcacaagtcctccaaacacagttaccggcgacagacattatttacagccatttcccaccgcccgggtcccctcccatggccatgccacccaggctccttgcctcgcagtccagttccagccctagggaaatccttgaccaatgtctctcgtgtctctcaggggctgtgtctcactaactctccttccaaatgcccctgaaacctctctcttgccttctgtacccaacatttgaacccagtgggcacaccatgttcccatgtcatttcacagtcagaggacaccggcctttcttggaaggagatgaccattcccgccggagctctcaccatcatttcatgtttgacatttcagaccctgacttcactcctccacacccactttcttctttttgtgaattcaaaatttctgaccataatgccatcatgttttgagctcatggtatatagttcaggggccactccgtcactaagcaggatccattcttctgctcagcaccctccatttcccggttcatctctctgccctctgccggcacgctcctgtttcacctgcccgatgacagccttgtccactcgctcttgtctccacctcctccctccccactgaagccatcctggatgcctccaccaaacaaaccgcatcaccctggcctgacaatttagaccacaaagctaggtccctgattttccagcactggaggcacctcccttggtggccccactcctgtccaggccactctgggcacctccagggaggctggcaagggaggaaactgcacagcagccactgtgtgactcacctacaagccacagagctctgtgggctgtcttccctccacacccaacctccgagacagcccccatcttccagcactcccttcctgtccccagccctcccggccccagcctcagcccccgactcttcttatccctcaagttgagggccacattccggggctctggctctgactctgccatctgcctaggatgaaacttccaaaaagtgtcttccatttttccacacgccccaacactggcctcacgcagactaagcctggacagatggtgagaagaaacatcccctagaaaatggcgtcttctacttcccatgtctaccagatgaaatcttacccgttcttcaaccatggccccaccctcctcactcacgaagagcctaggaattcaagagcccagggggcccatcagatccccaaactaccaccagagtcctgcaggcatctttaataaactcagattgaacgccttgacctcttctcagctgaagtgtattaaactatcaaaattctacagtgactaagtcgcttgtagcaggaatttcactggaagtacataaaacttccaaatcgtagccactactccacctacttctaagcctgaaggaagttaatattgcttttatcttattaagctacagggagagttcttgaccttccccattcccataagcaaagctatcattccacaaatcccctcacagaatttgactttcaacaaacacgggtgacttgctcactgaagacaatgtgcatttccaagtatcattaataactacaactaggaatggatcaaattctcctacacaaagcaaaagaataaagccattaaacttggcgtggcaggcagaattctaaaatgacccctggtgacccctggccttacagaatgctctcccctgagtaagaatatgatgggctgtcactcttgtggtcttcccccagggacatgttcaaataacatggccccagcaacactctggttgcagccttgtgaaacctggccaggtgactcttctatgggaggggggcaaggaaatgctgggtagagaagggtggggtgcctggcgagggctccaccctcaggcctgtgcccatggacctaagtgagaacgggcaatcctgttttcatgcccaaatgttgcatcttccaagaccactctggcctcccatgccccccatcctgtgcccataaaaatctgagaccatagtgggcatggacacaagcagctggatgttgaaaggaggagaagggcacaccaacagacaccagcagacactggcaggccactgacggcgggatgacacagaatttggtcgagggcagtcggaggagagtccagccactggccggcctgactccaggggaagacaccttcccactccatccccgttttgctccccatccacttcgctgagagctacctccaccactcaattaaacctcgcacccatcctccaagcccatgtgtgatctgatttttcctgtacactagggcaagaaccaggatacagaaagccctctgtccttgtgataaggcagagggtctaactgagctgattaacacaagctgcctgcagatggcaaaactgaaagagcactctgtaacacacacccactgaggctttgggacctgcaaacactcaaccctagacgatgccgtggagatggagccccaaaacactccccaaaacctacccatcttcatgttcccccttggagtttgaacagcggggcaccgaagaagcgaaccacacccttgtcacacgcccggtgaggcggataagggaactcctccggtttcaactctactaagcaaggtccagactcctaacccaagaaaactatgaggtattaagtgagtgttgtgtcaagctgcaaagtttatggtcatttgctacacagcaacagaaaacaattgttagggactaaatgtatgtgaccccccaattggagatgttgaatccctaacccgcaatgtaatggtatttggagatggggcctctgggaggtgattaggattagactgggtcatgaggatgacgccttcacaatgggactggtagctctacacgaggagaaagcgagctctcacgctctccgcacacacacaatgaggcagaccattcagagtgcaagtcagttattggtgtataaaaatgcttgtgaattttgcacattgattttgtatcctgagactttgctgaagttgcttatcagcttaaggagattttgggctgagaccatggggttttctaaatatacaatcatgtcatttgcaaacagggacaatttgacttcctcttttcctaattgaataccctttatttctttctcctgcctgactgccctggccagaacttccaacactatgttgaataggagtggtgagagagggcatccctgtcttgtgccagttttcaaagggaatgcttccagtttttgcccattcagtatgatattggctgtgggtttgtcatagatggctcttattattttgagatacatcacatcaatacctaatttattgagagtttttagcatgaagggctgttgaattttgtcaaaggccttttctgcatctattgagataatcatgtggtttttgtctttggttctgtttatatgctggattacatttattgatttgcatatgttgaataacagacaaaaagagagccaaatcatgagtgaactcccattcacaattgattcaaagagaataaaatacctaggaatccaacttacaagggatgtgaaggacctcttcaaggacaactacaaaccactgctcaacgaaataaaagaggatacaaacaaatggaagaacattccatgctcatggataggaagaatcaatatcgtgaaaatggacataatgccgaaggtaatttatagattcaatgccatccccatcaagctaccaatgactttcttcacagaattggaaaaaactactttaaagttcatatggaaccaaaaaagagcctgcattgccaagtcaatcctaagccaaaagaacaaagctggaggcatcacactacctgacttcaaactatactacaaggctacagtaaccaaaacagcatggtactggtaccaaaacagagatacagaccaatggaacagaacagagccctcagaaataataccacacatctacaaccatctgatctttgacaaacctgacaaaaacaagaaatggggaaaggattccctatttaaaaatggtgctgggaaaactggctagccatacgtagaaagctgaaactggatcccttccttataccttatacaaaaattaattcaagatggattaaagacttatatgttagacctaaaaccataaaaaccctagaagaaaacctaggcaataccattcaggacataggcatcggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctactcatctgccaaagggctcatatccagaatctacaaagaactcaaacaaatttacaagaaaaaaacaaacaaccctatcaacaagtgggtgaagggtatgaacagacacttctcaaaagacatttatgcagccaacagacacatgaaaaaatgctcatcatcactggccatcagagaaatgcaaatcaaaaccacaatgagatgccatctcacaccagttagaatggccataattaaaaagtcaggaaacaacaggtgccggagaggacgtagagaaataggaacacttttacactgttgtgggactgtaaactagttcaaccattgtggaagacagtgtggcaattcctcagggatctagaactagaaataccatttgacccagacatcccattactgggtatatacccaaaggattataaatcatgctgctataaagacacatgcacacacgtttattgcagcactattcacaatagcaaagacttggaactaacccaaatgtccatcaatgatagactggattaagaaaatatgccacatatacaacatggaatactatgtagccataaaaaaggatgagttcatgtcctttgtagagacatggatgaagctggaaaccatcattctcagcaaactatcgcaaggacaaaaaaccaaacactgcatgttctcactcataggtgggaattgaacaatgagaacacttggacacaggaaggggaacatcacacaccggggcctgttgtggggtggggggaggggggagggaaaacattaggagatatacctaatgtaaatgacgagttaatggatgcagcacaccaacatggcacatgtatacatatgtaacaaacctgcacgttgtgcacatgtaccctagaacttaaagtataatttaaaaaaacaataataataattaaaatattcaggaactatgaaaaaaaaaaaaagaatgcaagtcaggaaggagccctcaccagaaaccaagcttgctgacaccctgatttcagactttccagcttcacaaactgcgagaaaataaatttctgttaggtcacctagtctatgctatttcgttatggcagcctaagtagactaagacactacgacatccggagtgggacactggattgttgttccaaaacatctgctttctccccagacctctccaggaggggcagcacaggcttccctccccacacccctccccaatcctggaaacactgacacagctcccaacaccaatgcttgagcgcttggaactgactgtgcatgcattgcttgctgttcatcagtgagcttctgtggagccaagttggaaaacttttccctagaaaggtatagttctgccagtaacaggaatgcacccaggatttggaaacactgtgatgctcgagggcctcagctcacagcacagtagaaatcccaggccaagcccctaccttgccgtgggcatcaggctcagccacagtgctatggtggacactcatgctcagggcaagtcccttctccagccacatgccgcctgacgctgctccctgtcattgtgactccagccacctgccactctggcctcaattcattatttgtttatttgtttcttcgggagtgggacactggatcattttttcaaaacatctgctttctccccagacctctccaggaggggcagcacagacttcactccccccacccctccctgataccggaaacactgacacaggtccaaatacgaaggccaaatagattgggaaaggcatgatattgctcagggagaggaggcttaaccctaatgacggagggcctgcagaatggcttgagggaggcttttcacggcccaggtgctggtgtgcctcctccctggagaggccagctctggcccactggagaccaagggcggttgatgtaaaagcagctcagagcctctgctctgaaaccatcggatcttgaactgtttttgctcaattccagctaccagcaaggattatgttgcacattctgacatgtcagtaatcctgtaggttgattttgcaccactctcatgagaaaaagggtcatgaatctagttagccatgaaattaccgcatcatgaaaccttcatcccgtttaatttacaggtatcattattcagagtccacagttcacaaagaatatggagaaaacgaagagggttggggaagagtaacatagaattaaatagctgtggaaaaaaagccaaatagattggaaaaggcatgatattgctcaaggagaggaggccgaaccttgcgagcaccatgagttgtcacaaggacgccaactcgctcttttctccacttccccacccagcctaatagaggcaagagataaaatcagaacagagacagaacttcctgctgttgaggctgatgacaagggataacaggctgccgggaaataatggcatccttagagtcaaagacctgcccatttgattggtaccctgcctggacacagaggtctggaataaattagctctttaaatcttgtcctctaacactgaaaagttcttttacttcctaaaatcaagaatgttcttcagatcataaagtctggtccaaaggcaactgatagtgaagcaagtccttctagaacgcagtcttgaaagccaagtaaattactttcatgaaacatatggcagatgggtgcccaatagctacagagatatcaatttaccactaagaagccagcattcactgtgtgtggaaagaattgttgcaaaaacagagcaaataatattctgagtccaccaaccccccatcttccaaacctcctggactgcagctctgtgcaatattcctcctacagcctcctggagcagctgatcttcctacttcaccctccgtcaattctccttgctttgggtgtggctttctttctctgagtcttgctggggccacagaaggctcacgaggcatgcaggcctctaccatctgtctctacctttgaggacacactcattgctacccccaccctgtccatgctttctgccccctctccttagggcaacttccaactcaccattccctctcccagcctttcatcccaggctgtggtccaaacatcctccacaccatttcccttcaggggctgcaccaacacatcacactcataatgtccctgagaaaagttacctttcttctcaacctactgatagaaaaagaactctgcagctttcattatcttctcaagcagaagcaaaactataaattgatgacaaagatcacctcatgaaagagaaaaaactccttagtgttgaagtgttttaaaatattctaaataactcatgagtcaaaagatactgaaaggtgaaatacaccatggtctgttctgatgcaatgcatgcttctttgatgcacattctctcttaagtgcttggtaacaaactcatttgtccagggcctgccctgtaagatgctgcctcctcttacgggtatctactctgacattagggtagctgctggattttgttacttagtgggttattaggtagcacatatattattataatacattttaaaatatttttagtttaaaaatttcaaaataatttgtttcctttgtaatagtttttttggttttgttttttgttgctgttgttgttttgagacagagtctggctctatcgcccaggctggagtgcagtgacacgagctcggctcaccgcaagctccgcctcccgggttcacgccattctcctgcctcagcctcccaagtagctgggactacaggtgcctgccaccatgcctggctaattttttttcctattttttagtagagacagggtttcactgtgttagccaggatggtctcgatctcctgacctcgtgatctgcccgcctcagcctcccaaagtgttggaattacaggcgtgagccactgtgcccggcctttttttgtattttttagtggagaaggggtttcaccatgttagccaggatggtctcgatctcctgaccttgtgatccacccgcctcggcctcccaaagtgcagggattacaggcgtgagccactgtgcccggcctgtaatagttttatttcatgcttttaaaaaccttattctgagaagggatccacaggcttcactagattgtcatgacaaaagttatgaccccccccacccccgaccccgattaaagttcctttagagcagattttttggtgataaactcccgtttttggtttatctgtaaatagcttacttcgttcgccttgatgcttgaaaaatagttacgctggaaacaccctaggttgacagttgcatctctcaacagtttgaaactattattccactgttttctgactgccattgttgcagccaagtcagctgtcctcattctctaaagacttttgagatcatctccttgcctttagtattctgaactttttgcctggtatgttaggtgtggatttctttttaatcttctttgagagatactgtgctactgaatctgtgaatttatatttttcattcgttctggaaattttgtagctaatatctcttcagatattgtatcttcgctattctctttgccagggactccagtagctgtatgtttgtccttcacattccatcctccaaatgtcttagtttttcttccacatattccccacacatgtcattcatgacttcattctggttactttctttagctgtgtcttccagatcatcaattgtctctgcactgtgtctaatcagctgttgaactatataactgcacttgtttagaaaagttcagtgattatatctcaatatctagaaattcttttatttccaaatgtaactatttatttcaaatagttccttgttgtgtgctcatctatatgactgtgttgataatttctttaaatgtttcatacactaatgttctagattccaagacatgttgtcccaggagggtatcaaagtttgccctttgttgtctcattgtgatttgctttctttgatgcttgagcgcttggaagtgtttgactgtgcatgcattgcttgctgttcatcagtgaacttctgtggagccaagttggaaaacttttccctagagaggcatagttctgccagtaacaggaatgcacccaggatttggaaacactgtgatgctcaagggcctcagctcacagcacagtagaaatcccaggccaagcccctaccttgcagtgggcaccaggctcagccgcagtgctatggtggacactcatgctcagggcaagtcccttctccagccacataccgcctgacgctgctccctgtcattgtgactccagccacctgccactctggcctcagttcattatttatttgtttgggagtagggcagtggaccttgatgatctgcaatgcatcaaggagcatgtcttttgcagtgtatagttgttctataggagaagcatccttcaaagtgcctactcagccaaaatgccagaatcagaaggaaatcccccattcctggtgtttttattggtcccataaatacaccaataaagcaatgaatagaggctacttttatttttttttaaattaacaaatgttataagttatcaaaatatgaaactttatttagctaataaaattctttataaattccaaagtattccacatatcctattatttatttactcttttagccccagcaactatatttctcaaatcactttactttcaaaaaaacaaaatgttatcccaaattattctttccctccattttcccctggaaaaaaatattactcccatccaaagcctttctaattcagtagctttcctacatgctggtaagaaactgtaagacaaggattccattcacaaaagcaaaaaaattaaaaactatccaagaattaacttcatgatgaatgtataaggttttttaaaaggcaactacaagactctactgagacataggaaggaagatttttagtaaatggacgtatataccatgttcccaaatgaggaaacctaaagataataaaaatgttaatttctctatattcataaattaatttagtgaaatctctatcaaaatcccaatgggattctttgaaggttgacaaaatgattcaaaaatttatctgaaggaaaaatttttccttcagatagtagagaagaaacaatgtcattgaactatgtggagggaaagaggtttatgtattactggacacaattttcatcccttcattattttaagttaaaaattcccaggaacaaaaacagtttagaaagccacaatagttataagtggctcaagaacaaacagacctgtaaagaacagaatataatgtccagaaagagacttaggcatatattagggttttaaaaaattatttgttttttagattgtggtaaaatgtacatacataaaatttaccatttaaccatttttaagtgtacactcagtagcattaagtccattcaccttgtgcaaacattcccctcatccatctccagaaaacctttcatcttgcaaaattaaaactttgtatccattaatttacaccgattccccattccctcccccactctagcccctgacaaccaccattcttctttctgtctctatatgagtggaatcatagttttatccttttgtgacaggcttctatcacttaggataatggtttcaaggttcatccatatgtagcatgtgtcagaatctctttttttttttttttttttttttttgagacagttttgttctgtcgcccacgccggagtgcagtggtgtgatctcagctcactgcaagctctgcctcctgggttcatgccattctcctgccttagcctcctgagtagctgggctacaggcgcccaccaccacgcccggctacttttttttgtatttttagtagagacggggtttcaccatgttagccaggatggtctcgatctcctgatctcgtgatccgcccgcctcggcctcccaaagtgctgggattacaggcctgagccaccgcgcctggcctctccttcctttgtaagtctaatagtattctgtacgtatagacctcattctgttgagccactcgtctacagatggatgcttgggttgcttccaccttttagctatgaggataatgcttctatgaacacaggtgtgcaaatatgtctttgagacccttctttcaattcttttgggtatgtacccagaagtgaaatatggtaattctatttgtaataatacagagtggaaaacagtataaacctcctcaataattacaaatagaattaccatatggctattatttttataatagccattctgatgggtaggaagtggtagtcattttgattttttctcttttttctttctttttttttttttgagacagggtctcactctcacctaggctggagtgcagtgacgtgatcacagctcactgcactttcaacctcctgggctcaagcaatcctccctgctcagcctcccgagtagttgggactacaggtgcatgccaccacacccagctagttttcgtatttttttttctcaagagatgggggtttcgccacgttgcccaggctggtcttgaactcttgggtgccaacgatcctcctgcctgggcctcgaaaagtgctgggattacaggtgtgagccaccacgccagccattgttgtgattttgatttgcatctccttaaggattagtgatgttgagcatgttttcatgtgcttattagccatctgtatctcttctgtggagaaaggcctagtcaagccttttgcctatctttgaagctttcctcccagctttattgaggtatgactgacaaataaaaactgtatataaaatgtacaacatgattctggtatacatatactgtgaaatgattaccacaatcaagctaaccatatccatcacctcactagttaccatttcttctgagtgtttgataagaacatatgaagtctctttcagaaaatttcaaatatacagcacattattattaagtatagtcactatgctgtacattacgtctccagaatgtatttcttttataactgaaagtttataccctttgaccaacatctcccctttcccctctctcccccagccccgggcaactacgcttctcctctctgttaccatgagtttgactttttttttttagagtctacggacaagtgagattattcagtattcatctttctgtgtctggctaatttcacttagcataatgtcctctgggttcatccatgttgccaaaaatcctttgcccatttttgaattgtgttctttacttttttgttattgagttttaggagttttctatatgttctggataataatttctgatgaaatatgtgattttccagtactttttcccattctgtgggttgcctgtttactctcttaatagtgtcctttgatgcacaagtttttaattttgatgaagtccagtttgccacttttcttttgttgcttatgcctttggcatcatatccaagaaatcactgccaagcccagggttgtaaagcttttcccctaagcttccttctaagagttttataactttagctcttatgtttaggtctttaatccattttgagttaatttttgtataggatgttagttaagggtccaacttcattttttttgcatgtgaacacattaaattagtttttacaatttaatttatataattcagttatacaaggagtgacatagtaactgatgggggaaaaggctattcaataaatggttctgggataattgttaaatgtaaataaataagcagatagagaaattaaaattagttccctcccacaaaccaaaatacattacaagatgattaaaatattaaatgtaaataattaaccacccaggttactggctaaaactcacagaaaggcaactgctcctcaaaaaaatttactgagaggccaggcacagtgggtggctcacacctgtaatctcaacactttgggaggccgaggtgggcagatcacttgaggtcaggagctcgaggacagcctggccaacatggtgaaacctgtctccactaaaaatacaaacaattagccagacatggtggtatgtgcctgtagtcccagctactcaggaggctgaggtaggagaatgtcttgaacccaggaggcagaggttgccgtgagccgagattgtgccactgcactccagcctgggcgacagagtgagactccatcttaaaaaaaggaaaaaaaaatttactcagaaaaacaccttataagtaagtaatcaataaaatgcaaagtggaataagaggtcccttgctgcctgtcaagctagcagtggttagaaagaacagtggtcctcacttacagggctgtagagaatgtacatcattaagaggtgcgatgctgtcaactggcaaaaagtataataaacaaagcatgggctctatgcaaataaattcaaaacccaggatgacaaagataacttgctaaattactacaattgattccccaaaagaccaaaacactaactgttcccataaacaccaagaaattggaaatatgctcaaacagctgtaggcaaagtcttcaaaaacttctacgtatgaagatttccaaagctgtttaaattttttctgagcacagagggaaaaaagggggaacttccaaattgtctttataaaggtcagtgtaacaatcacaaacctgtaaaatatcacaaaaataaggaacagaccagtggcttttaaacagaagtacattgtttttattttatttttcctgtgctggatcaatatttaatgaatttcccccatgtatcaggcattgttggactctttcagatatttaactccttccccctcattatttatttggcaaaagttacattaagttattccctcccctcacaaagcaggttctccctgacttcaagggccaacatccaaacaaaaccaaacatgaaagacagagactcaaaaacttagcattcctcatctactacacatactagatataaacacacaaatttaaatgccaaaaactcataggacagtgcattaaaatgataattttactggtacatcatttttaaataaaaggttagaaaacagaattcagcagtacatttaaaagaatgaagaacatgggggttcacgtcaggaatgaaaagatggttctgcatattaatgtgacgaaaatgaaaaattctttcattcagtagatgcatggaagacgtccaatagaatttgatctccatcctctcttttaaaaaagaactcttagggctgggggcagtggctcacacctgtaatgccagcactttgggaggccgaggctagcggatcacttgaggtcaggagtcctagaccagcctggccaacatggtaaaatcctgtctctactaaaaatacaaaaatcagctgagtgtggtggcacatggctatagtctcagctactcgggaggctgaggcaggagaatcactggaacccgggaaacggaggttgcaatgagccaagatcacgccactgcactccagcctgggtgacagagcgagactccgtctcaaaaataaaataaaataaaacaaaatgattctgaaagtactcgtgtggtatgcagaattatgagatggcccccaaggtccccactccctggtgtacctgccctgtgtaatcctctcccttgggccgtgggtgggactgtgaatatgtatgtgattaggttacgctgcctgacaatggtggatgggaggtcccaaatcagtttgctgttgagttcatcaaaagggaagttctcttgggtgtgcctgacctaatcaggcaagacctttggttctgggcccttggtgaagtcccaatttgaggtgtaagaagttgtgctgctggccttgaagaagtgggctgccatgtggtgagatgcctctaagagctgagagcttccccacccacagcttgcaaggaagcagggctgagtcacacaacccccaaaatgaattctgccaacaacctgaaggagtttggaagtggatctttccctcgtaaagcttttggatgaagatgcttccagcctcaccaggatttcagcctgcagaccctgaggacaggacccaattaaaacactccagagtcccaacccttagaaactctgaaataataaggttgagctgtttgaacctgctatgcttgtggcaatttgccacataacaatagaaaactaatatatctagctaataacactaaaaaggaaaaataaaagaaagttataaacattggaaagaagaagcaaaatcattactatttgaaaataaagtgatcacctaattagaaaacccaaaggaattgattcagaagaataagaaaccataagaaaattcagtatgttacctggttacaaaatcaatatgttgaaaattataatactatatatagttgtcccttgaacaagaggggtgttaggggcaccaacctcctgtgcagtcaaaaatctatgtataacattttcactcctccaaaacttaactggtaatagtctgctgttgactggaagtcttaccaatcagataaacagttgattaacacacattcacattttggatgtcgtatgtactatatgctgtattcttacaataaagagaaaagaaaatgctattaagaaagtcataaggaagagaaaatatattttactattcattaagtggaagtggatcatcataaaggccttcatccttgtcatcttcttgttgagtaggctcaggaggaggaggaggaagaggagggctcagtcttgccatttcagggtggcagaggtggaagaaaatccacatataagtggacctatgctgtttaaacgcatgttgttcaaggtcaacaggatcaatatttattgtgccctgaatatatgccagatatacttactaagtttttatactttatcctgacaaccctaattagtatgtgtgactcttgtgcccgtgcacatatgtgaaaattaaagcacaaagagattaagtgacttgcccaacgttacaatgatgggcagggttaggacacaagctcttaaactatagacaaacagctttcctacatatgtgcaagcaaagactggttagaaaagagaatacaattaaaaattccatttataatggtaagcaaaaaggcagaatatcttagaatacacagatttaataagaggtgagcaggagcaatatcaaggaatccttaaacatctactggggaacctaaaagacttcatgactagatgggagggaaattcattttttaaacaaaaagactaaataatgtataagttccatgcaactctaattaaaataccaaaaaggggaaaagaaaatctacgcaataagaagtgctagggcaactggctagccacttggaaagaaatgaaacttaatctctacgtttcaacattaaaataaattccagagaaatcaaagagtaaaatataaattaaaacataaatatttgagaaatttgtaaaagaatcttgaagtaagccttttaaggcaccacacaattttaagacataatagaaacaattaataaatttaaaatgtatacgtttatggctaaaaaaacccacatttgtttgtggtaggaggaatctgtgttctcaatcccagggcctctctgcatctgcattagaagaacaagtctgtgcctttgacgtgtgaggtcggaggctcctgcagagtgggtggagtcccgtccccatcccagaataaacttggccatgggatatgcctggtggtgagtggaagtggcacatgccatcgccccgggccttctgatgcactacgtgctacctcttgccctcctccttgcccaggtggccactgccccttcaagcctgggccccggaatggacagatggcacagacacaaaccccatgagaagcttgcaacccaaagtggagccaccccagctgacctgcaaacccagaggagaaaataatggctcgctactgtcaagcactgcattttggtgtggtttttaatgtagcattattctgaaaagggccaatgaacacatttatggttaaaaaaaacccataaaaccaaaggctggtttcaaataggaaaaatatttataatacataaacagacaaaaggttttcttaatttacaaagagctcgtataaattaataaaagaaacaacagaaaaaaatggctgaatacgatgaataggatgtttagatttttaatgaacaataaacatgtaacagaatgcgtagacctactgaattttctaaagcaagtgaaaacaataagataagtatttttttcaacgagactggaaacattttggtgaagttttggtaaaacccagtgatggcaaagggcagaggggaaagaaagttcctcttaaacatttcttatgttggcataatttgatgtagccttccttgggaacaatttcatagcatctctcaaaataaaaactgtacatacccatactcaatggtttcaatcctgggaatttaacctgtggatatactaacagaaacaggccagcctatttacacaaggacgtttactacaaaaacctgaaccagtgagtagcaataaagggctagttaaaaagacttcggtatttacatagaacatgaatatgtgcattataaagtttgaggtagatctatttatgccactgtggaatgatctcgaagataaataactgacaagcaagacacagcccagtgtgcactgaaggatctctgtgtaaacaagaaggaatggatgaatgcatttactacataaacattgctctcttggaacgacgcacaagaaacctaacaatcggaaactagattaaggaggaggcgagggggaacttgcttttaaatgtgtaactttctgtaatattaacctttaatccatgcatgtattatgttaagcatatttaaaactctgcataccattgaacctagaattctacttctaagaattcccagtattaaccaaaggattatgtattttggaaactggaaacaaccgaggtgtgcagcaagagggaattacatatattcattgggtccttcctagttgctgccattaaatcatattatagaagaatatatatatatatacacacacatatatatgtatattgtattgtgtgtgtgtgtgtgtgtgtgtgtgtatatatgtatattggagacaaggtctccctctgtagcccaggctagaatgcagtggcatgatcacagctcactgtgacctccacctcccatgctcaagtgatcctcccatttcggcctcccgaatagcagggaatacaggcatgcatcacccggctgatttttgtatcttttgtagagagagggtttcactatgttgcccaggctggtctcgaactcctggctcaagtgatcccctcgctgtggcctcccaaagtgctgagattaaaggtgtgaaccactgtgcccagccacaggagaatatttaatgccatgtagaaacgttcacactaagtgaaagaagaagaaggaaaagcaggttgcaaaatggtgtggaaagtgcataatttcccttctgagaagcaaacaaatacataaagaaaatcagcagctgcatctcaaagttaccatggttatctccagacagtgagattttggcttcctctttatttttctgtttcccatggttgatacacaacagagaaaacgcactattaaaacccaagccagcgacagctggttctgcctcctaagtgaggaggcataacccatgccagtgggtactaactccctctaatgttcccatcagcaggcgggagaggtggacggggccagacaaattccaccacttcaatgtgagggccgatggcttcagaacaggtatggaaaggctctggaaacaatggcggccagtctgagtgagaggcagcaaaccagaatccctgcacagtgacggggtccaaggtggcaggatgaccaacaaggtgtgtaggggagggacggggcctgatctgcacagaaagtggttagccaggtggccatgtacacttctatgtgggctgctgctccttgatagagaataatgagaatttcagacataaatgcaagctacaagaataaattccaaccaggacccaaacgtattcaagagcctctgcccccctccctttctcaacccattgtcagaaaaaagtatgaagtgggaaggtagattgccctgcttgaaaaagagtattacataaaccatttgcaaatgacttttattctcttcttttagaaatctcctcatggcacaataataaaaacaatgtatttgttgatacagaacattaattccattaaaattgcattatgtgtaatgaaaagctatcagagtataattatgcaagcaaattcacagactcacatcaacttttaaatccactggaactatacaataggaactgaagctgtctggtagacaaattgctctttcttttccaaatcattatgaataaaggccactgtactaatgtcataaaccgcacactatttatgcaaactctcaaatccaggactgttccctagaggtgcctctgcctggtttttcccaggaccaacctgttctcagacccagaggctgtgctcccattcctgacttagccccaaagcaggctcccttctcggaattcttgcccagagagcccagttgtaccctgaagggagcctggttgcacccccaaagggttgcctgaatccgcacactctcagccctctgccccagcctgggagctgtgctctgctctgctgcccctggctggccgctgcagggcccgcaggctgctctccctcctccctgctgcaggtactgcacccaggtggccctcctgccatctctgctcacaccaggcagcgccacccacagagactggagtgcagagcccatctcctgtccccacgaggttctgagaggaggcagagggccaccaggacaggggaggaagggggcacgaggctggattcctgcaagggcacaggagtacatccagtgccgcccactcccgctgatgatagccccggtgaaaagacacaccctgggaaagggactcagtctatgcccctcactcatcacctatgtccatccctgggtttagacacttctaggatccccaaacacagtagggatatggacaactcgtgccatgctggtgacatgaagggaacccccccatctgactaagtggtcccagcacccttgtaatagccgtctccactccccagtcctgctcccctttcccctcactggcacaggcagaactcccctgtctggtcagttctgggtcgctgagtcccaggaacccccttcagcacccagcaggctgacactgatcttactcctgctttgcagaaggaacaccctcctgccttggccgcccccttgcttcctcccccactcacactccccagctgctcgttagtaagggctccctcggcccatcatctccccatacctcccctcccctcctcgcagtatctatcctgggagagcctgttccctccctggctccatcctccagggtaccctaagcctctctcagcctctcttcctcccagatccctgtgtccacccactggcctgatggaaacatgacggatgcctccccagcagcctaactcaatacagccagtgctcctggagcctgccctacctccacaggaggccccactcacccagatgtgcctgtcagggtcccagataccccacgtccctcccccacccaatctcactctcaaatccatccaaatcagggacatctactgaccagctcaccctgggccccggcccccagttcctccctccacctggtacctggctgccacctggcaggagagctactgtaagagccctacaaagccctccctgcctggactcctggtcacttctaacctgttttccacactgcagaatcatctttttaaaatgcaaacctggctgggcgtggtggctcacacctgtaatcccagcactttgggaggccgaggcgggcagatcacctgaggtcaggagttcgagaccagcctggccaacatggtgaaaccctgcctctactaaaactataaaaattagccaggcatggtggcatatgcctgtaatcccagctactcaggaggctgaggcaggtgaatcgtttgaacctgggaggtggaggttgcagtgagccaagattgcaccattgcactccagcctgggtgacagagcaagactccgtctccagaaaaaaaaaaaaaaaatctgaccatgtcactcgccccactcaatgacactgtgccctttaggggctttctttatcccttggagtaagtcccacatcttccagctcagaaggtccctgcctacccttcctgcttcatccaggtcactccatgggtggggtcacctctgcctccccctcaacccccaaacagctaattacccagactgggtagcaaacagctacaggaccacggggctacggcaccagcaccccacagtgccgctcactcatgcacctgcctttggctgctcagcaggtcctgggggcccagagcacgcttgtttcatctgcacagtgcccaccggagcaagggcctggtgccatggcacacatgagagtgaaggctgtcggcacgcacaaggttggccagcgcccacctccgggcgggagactttgtgcccatgctcctgaccagcttcacagccccacggaggcagcacggtcctgaggggcagtgtgctgacttttcccctttattttataaccaaaacaatgcaagttcaatatagaacaagttaggaaaggcagataagctgaaggaaataatgaaaccatctacattcacacggcttctcctctaactcctgttaacatgtggctgggttctatttaaatcggtttttataaaaattgggtcatcatgttgtcaataacctttccacattaccatataatgtgtcatgatcatgatggcacaccctgtaggtattcactgacatcaccttaatggctgaatgggactccattgtataaaaatacaaaatactcatgacctattattctataaacatttggaatcacaaacgtatgtgaaaaatatattttttaacaagcttatgaaaagataaacataagcctgtaatcccagcactttgggaggccaaggcgggtggatcacttgaggccaggagttcaagaccagtttggccaacatggcgaaaccgcatctctactaaaaatacaaaaaattagtcaagcatcatagcaggtgcctgtaatctcagctactcggatggctgaggtaagagaatcacttgaacctgggaggcaaaggttgcagtgagccaagatcatgccactgcactccagcctgggcgacagagcgaaactctgtttcaaaaattaaaaaaaagaatattaaaaaatatattaaatatatgaatatatttttaaaagtatttcattttttctgatctagtcattcttacacaatctgaagtcaaaattgttctgtagagaagctgccacttacaacaaatagttttgcttgtttcttcagtttactttcacatttctaaacttgatgctttgactgacttctgactatgaaaattgaggattctcactttcccctccaacacacagcagacacagccaaatgcacacactcgctctccctctcctcctcactttcccaatccaaatatagcaacaacccaccttttgatatttcagcattcagtattggcattattatgactacgtaaaatgtcacccataactgagccacaaggagtactacaattacagtgcctttaaaaaaaatcacatcacaatatgtaactggggttaattgcctcatttttcacttacatcttctacacagtcacacatgatttaacaacggagctatgttctgagaagtgcgcccttaggtgagtccatcattgtgtgaacctcacagaatgcacttacacaaacctagatggcgaagcccactacatacctaggctgtatggtacggcctactgctcccaggctacaaaactgggcagcatgttactgtcctgaacactgtaggcaactgtaatacaatggtgagtactttgtatttaacacatctcaacataataacggtacagtaaaaacatggtattagaatctcatgggaccaccattgtatacacagtccgtcattgagggaagcgttggtgtgtggtgtacgactgtatatctatcaaaaattcatcctagctctccaacagccctgaggtctccctcaccatgtatgagcacatgaagtctatcaaaaaatgagggagcaaaccaagaaaagagaagacatgggctcaagaaaacagaggctctagcccaggagagaggcgaaggggagtcgaagacccagggaagtccctaggagccatagtgcaccaggccagggcacagccaggtaaggagggagcaggtgacctgggtccaagaaggacatatctcagcaaaccagagtggtttgctccccatttttttgggttggggggagcccgagtctctctgtcacccatgctggagtgcagtggctcgatctccgctcactgcaacatacacctcccaatcaagcgattctcctgccgcagcctcccgagtagctgggactacaggcacccaccagcacaccccactaattttttggggttttttttgcatttttaatggagatagcgtttcaccatgttggccaggctggtctcgaactcctgacctccaggtgatccacccacctcggcctcccaaagtgctgggattacaggcctgagccactgcacctggcccacattttttgatagaccatatcctccactaactttcagagaaaggatttacagtaggtgaaatctgagggaccctacacgtttaacatgtaaggacagaaattttaggttgcagattattttgtctcagaactttttaggcaacgatctaatatgtgctgatctccatggtggctccagagtggtctgattcatcagcagatactggcaaggaccagctgtttaccaggcactgttctaggcacaggggatccagcagtttaaaaaaaagacatgcatagtgcctccctcatgacatcctggggagcagcagaggagggagacacaaaaataagagtgaaaccacatggcatgttacacagaatgaagaaaaataaggtgggaaagtgtgggctcaggagctgggaaatcctgggcttgtaggggtaacagatcccaaaaggaggaacgccctggtgggatggatgccggttcctgatggggatatacaggactctacaatggtgagacggtctttgtttttattcactgggtgaagtatgagaaactgatctgaatctgcaatctcctttcagttctgagaataactcctgtatcattttgcaatgatgattctacttcctttggtctctgcaaagcctatttatattctctggctgaccctctcatttactgtcttccctatttccaacttcctggtctttttttgttgttgttcagttttctgagagatttcccccaatttcatctttcaagcctttgatgatttttaaactttatattctgaaatttttcaaatagaaaagtacaaaaataagaatgttcaatccatctacttagcctgtcacgttaacaattttactatatttgcttcatctctttttctttgcttttcaagataaattacaaaccatgacattttaagtttttcaatatgcatacctaaaatacaaggacatttttctatataacctgtgaggccattaacacatctaaaatatactaattattaatagatcatctttgtatgatttcatacccaattcctattcaaatttcccagattgtccccagaataacttcttgcagttaatttgttcaaactagcttccaatgcttaggaatttgttatgtgcctacatggttgtaattttgttaagtagctttaaattttcagcttgttctttaacccacatgtctccggttttcagggtaggcaagggttttaatacaattatggtttcatcccttcacacatcccacatctctttctttgctagtataatctagaattttagattcaaactcatattacattgttttcatattatactcagtatcttttttcctttataaaaattaatttttcttttttttttggagatggagtctcgctttgttgcccaggcaatctcggctcactgcaacctccacctcctgagttcaagcaattctcatgcctcagcctcctgagtagctgggattacaagtagctgccaccacacccggctaatttttgtatttttagtagagacaggtttcaccatgttggccaggctggtctcgaactcctgacctcaagtgatctgcccaccttggcctcacaaagtgctgggattacaggcatgagccaccgtgcccggcctatttttctttttttttttttaaagacagggtctcaccgtgttacccaggctggtcttgaacaccctggctcaagtgatcctcctgccacaacctccgagtagctgggacttcaggcatgagccacctcgcctggctatattctgtgtctttcgatgttttttaaatttccactttccagttataactagtttcagtgttctgcattagttctgcttagccatgattccaccaactcaagctgctaacttaatagctcaaacgttgaatgacatcttcacgagactcctgtgagggtccccaaagcccccgatacctgagcatatcttcagggctcccaggaccaatatggactgctcgcctgctcagctatcatcacgtctgaagagcaggtcgccctagcgcaggtctggattcacagactttcccctcaatcactgcagatgctgcgtgcctgccctctgctttatcatagcagagaactctaaggcctgtctctttgtttgtatgtttgctttgctgaaaataaggtcccctacctagatgcttgtggaatcccattcttgaatttgcattgataatttcctttcctttctctctgaaacttttctggcatacttagttcatctccgcaagacagtgtgtttggtgttgcttgtttttgcactttacaaaaacagtgtcatagaaaaaacatagtattttttcatgtggtctcacaggcagagaactaattggctcctgcactgcaggtctcactcccctgcaggggctgctctggtggaagccagagcagggctgccccaggagcagccctggggcaacagagacttgaggcgacgggtctcggggaggcaagcctgaaatgtgctcggtaactgcactccagtcccctcaggagccagcacgatcacccgccgtagccaactgggtaacacacttggactagctatccttcctccctgcctccctctgccttcctgactgtgctctgcgcaaacaagagagattcctgctagtcctgctctcagtctgctttcagggtcatccaggctaagaacattcacgttcctaagattcctttatcatgttgttgcacacagctatagtttattcactttcactgtggtataacaacagtccatttcgttagaccacagaacttattttgtttgtttttgagatggagtcttgctctgttgcccaggctggagtgcagtggcacaatctcagctcactgcaacctccgcctcccaggttcaagcaattctcctgcctcagcctcccgagtagctgggattacaggcgtgcgccaccgcgcccagctaatttttttatttttagtagagacgtggtttcaccatgttggtcaggctggtctcgaattcctgacctggtgatccgccgcctcagcctcccaaactgctgagattacaggcatgagccactgcgcctggcctatataatttattaatatcccattcttctgctgatgaacatctgcactgtttccagtttttgctatcatgtactattcgttgatgactatcctggtgcacgtgggcaggagtttctgcaaggtatatgcttatgagtagaactgcaggtcacggtatgtgtgcatgttcagctatagaaaagaatgccaagttgtattccactgtattccagagtggtcccacccatttccactcccaccaagaattctcctgatccacattctgtccaaattggcattgtcaaacttcttaattgaggccaatctagtaggtgtaaacgatttctctccacagttgaattttacatgtccatgctgactggggcatgtgttgacacgtttattgaccctacatatgcccacttccatgaaatgcctatgtaagcattttgtccacttttctattgagttttgtgcctttatcctattgatttgtgggagttcactacatgaaatcataatcagttatgtgtattgcaagcatctccttccagttgtgtttttgctttcttcgtgatgtctttcaataaaaagaatgtttaaatgtacttacctttcaaacatatttttcagctttggcgtttctctgtcttgtttaaaaaattctttccaaatttcttacatcttacattttattctgtaaagttccaatgttttgctttcacagttaagtgtttaaaccacctgacactgattctcttgcatggatagccaatgatcccagaaccatttatggtagactccctgaattctgctcctggcctgccctgcatcgtttcatatatgcttcaggctctatcttatgttttgctgattgcattgtcttcctttgcacctacacttactgtctatagcttaaaaatgagtcttatacgtggtagcataaattccccccaaattcttcaggagcctcttgactttccttggcctatggctctgtcatataattttacaattaggttgttaagtcttaccctcccaacaaaaacatttgtcaggatttttaatgaaatcaattgaatctgatttggaaaaaaaaaacagccatcttcacagtattgagttagcttagactagctctctcaatatggtatatccctccatttatttaggttttatttaatgtctttcaataaagttttacacttttctgcatattcaaattacatattttttcttagatatagttctaagttccttatttttgtgctattgtaaataatgtccttaaacaatttacattttctctctgtggctgaagtataaagatacaattgatttttggtatattaaccttctagctaaccaccttgccaaactcattatttctaattgattgtagatggcttattcctgattttaaagggaatactttcaatgtttcctcattaagaataaaacagttctattaagtttgtatatgtattttttctataacttaagttctgttacgtttttctataaatctgtccattacatctgagttatcaaatgtgtagtctctcatcaactttttgatctcttctgtatctgtaattacatcttccttttcattcataataatggttatttgtaccttcttttttgttcttacacattcttaccatatttgtctattttgttagaattttcaaggagctaccttttggctatgtttatcctctttattgcagccttatattctatttcgttaatttctattcttatgtattatgttctttaaatttattcattcttctttttctaagtaaatctgatcacttcattcctattcttatgtattgtgttctttaaatttattcattcttctttttctaagtaaatctgatcacttcattcattttcaattgtcaatctttctaggtacctaaggctattcatttgcattacaatttcttctttgattaatgagttattaaaatctttttttaatttccaaatatattagggtcatttatccttttgttatttatttctaacttaattaaattgtggtcagagaatgtgatctccttgatattcattctttgaaatgttttgatatttactctacaaactaaaaaactgcaagatcaatttcttaaagatagtccctgtttacatgagaacatctctgaaagctgcagaattcagtatatgtaaattatacctggttgtgttctttaagttattacataatttttaattttctgtctgatagatcaacaatcaatatgtattgaaatttccttttcatgacagattgatcgatttctacctccatttttatgtgttttttctttatacgctttgcagtggtttaatcaaaagtatataagcataaaattgtacctatttgttatatgtaatgagcctctctctaacaaggctttttgactgaaagtcgattttgtctgatattaaaatggctctgccaatattcttttggttgacatctgcccacccaaacaactacacaaaaatctacaatttccaaactacattgtgaccagggttcattcatcacaacccctacatacgtacggtattttgcttgtgaactctcttcccctcttcctaccaaattttcttacagctttgaaatttgcctggacttcctaaaatgacaatgtcccagggaaatgttcaataatctgggtaaggagagacacacataggctcaaaataaagggatggaggaagatctaccaagcaaatggaaaacaaaaaaaggcaggggttgcaatcctggtctctaataaaacagactttaaaccaacaaagatcaaaagagacaaagaaggtcattacataatggtaaagggatcaatgcaacaagaagagctaactatcctaaatatatatgcacccaatacaggagcacccagattcataaagcaagtccttagtgacctacaaagagacttagactcccacacaataataatgggagactttaacaccccactgtcaacattagacagatcaacgagacagaaagttaacaaggatatccaggaattggactcagctctgcaccaagcggacctaatagacatctacagaactctccaccccaaatcaacagaatatatattcttttcagcaccataccacacctattccaaaattgaccacatagttggaagtaaagcactcctcagcaaatgtaaaagaacagaaattataaggaaccgtctctcagaccataatgcaatcaaactagaactcaggattaagaaactcactcaaaaccactcaactacatggaaactgaacaacctgctcctgaatgactactgggtacatcacgaaatgaaggcagaaataaagatgttctttgaaaccaacgagaacaaagatacaacataccagaatctctgggacacattcaaagcagtgtgtagagggaaatttatagcactaaatgcccacaagagaaagcaggaaagacctaaaattgacaccctaacatcacaattaaaagaactagagaagcaagagcaaacacattcaaaagctagcagaaggcaagaaataactaagatcagagcagaactgaaggagatagagacacaaaaacccttcaaaaaatcaatgaatccaggagctggttttctgaaaagatcaacaaaattgacagactgctagcaagactaataaagaagaaaagagagaagaatcaaatagatgcaataaaaaatgataaaggggatatcaccaccgatcccacagaaatacaaactaccatcagagaatactataaacacctctacacaaataaactagaaaatctagaagaaatggataaattcctcgacacatacaccctcccaagactaaaccaggaagaagttgaatctctgaatagacaaataataacaggctctgaaattgaggcaataattaatagcttaccaaccaaaaaaagtccaggaccagatggattcacagccgaattctaccagaggtacaaggaggagctggtaccattccttctgaaactattccaatcaacagaaaaacagtgaatcccccctaactcattttatgaggccagcatcatcctgatacaaagtctggcagagacacaacaaaaaaagagaattttacaccaatatccctgatgaacattgatgcaaaaatcctcaataaaatactggcaaaccgaatccagcagcacatcaaaaagcttatccaccatgatcaagtgggcttcatccctgggatgcaaggctggttcaacaagtgaaaatcaataaacgtaatccagcatataaacagaaccaaagacaaaaaccacgattatctcaatagatgcagaaaaggcctttgacagaattcaacaacccttcatgctaaaaactctcaataaattaggtattgatgggatgtatctcaaaataataagagctatctatgacaaacccacagccaatatcatactgaatgggcaaaaactggaagcattccctttgaaaactggcataagacagggatgccctctctcaccactcctattcaacatagtgttggaagttctggccagggcagtcaggcaggagaaggagataaacggcattcaattaggaaaagaggaagtcaaattgtccctgtttgcagatgacatgattgtatatctagaaaaccccgtcgtctcagcccacaatctccttaagctgataagcaacttcagcaaagtctcaggatacaaaatcaatgtgcaaaaatcacaagcattcttatacaccaataacagacagacagccaaatcatgagtgaactcccattcacaactgcttcaaagagaataaaatacctagaaatccaacttacaagggatgtgaaggacctcttcaaggacaactacaagccactgctcaatgaaataaaagaggatacaaacaaatggaagaacattccatgctcatgggtaggaagaatcagtatcgtgaaaatggccataatgcccaaggtaatttatagattcaatgccatccccatcaagctaccaatggctttcttcacagaattggaaaaaactactttaaagttcatatggaaccaaaaaagagcctgcattgccaagtcaatcctaagccaaaagaacaaagctggaggcatcacgctacctgacttcaaactatactacaaggctacagtaaccaaaacagcatggtactggtaccaaaacagagatatagaccaatggaatacaacagagccctcagaaataatgccgcgtatctacaaccatctgatctttgactaacctgacaaaaacgagaaatggggaaaggattccctatttaataaatggtgttgggaaaactggctagtcatatgcagaaagctgaaactggatctcttccttacaccttatacaaaaattaattcaaggtggattaaagacttacatgttagacctaaaaccataaaaaccctagaagaaaacctaggcaataccattcaggacataggcatgggcaaagacttcatgtctaaaacaccaaaagcaatggcaacaaaagccaaaattgacaaatgggatctaattaaactaaagagcttctgcacggcaaaagaaactaccatcagagtgaacaggcaacctacagaatgggagaaaatttttgcaatctactcatctgacaaagggctcatatccagaatctacaatgaactccaacaaatttacaagaagaaaacaaacaaccccatcaacaagtgggcaaaggatatgaacagacacttctcaaaagacatttatgcagccagaaaacacatgaaaaattgctcatcatcactggccatcagagaaatgcaaatcaaaaccacaatgagataccatctcacaccagttaggatggcgatcattaaaaagtcaggaaacaacaggtgctggagagggtgtggagaaataggaacactctttcactgttagtgggactgtaaaccagttcaaccattgtggaagtcagtgtggctattcctcagggatctagaactagaaatactatttgacccagccatcccattactgggtatatacccaaaggattataaatcatgctgctataaagacacatgcacacgtatgtttactgcagcactattcacaatagtaaagacttggaaccaacccaaatatccaacaatgatagactggattaagaaaatgtggcacatatacaccatggaatactatgcagccataaaaaatgatgagttcttgtcctttgtagggacatggatgaagctggaaaccatcattctcagcaaactatcgcaaggacaaaaaaccaaacaccgcatgttctcactcaggtgggaattgaacaatgagaacacatggacacagtaaggggaacatcacacaccggggactgctgtggggttaggggagcagagagagatagcattaggagatatatctaatgctgaatgacgagttaatgggtgcagcacaccaacatggcacatgtatacatatgtaacaaacctgcacgttgtgcacaggtaccctaaaacttaaagtataataataataaaatttaaaataataataataataatctacgtaaaaaaagaaatgttgatgtggctgaaatatatatgtatgtatcttgcaaatataattcatggctattttccatataaatcatctcaaatcaagatttgattttctctaacagatctggtctgaaaagtatagttatgaacaggagtggagtcatgggcattcactgcttctttaattgcattttctggaaaactctacagttctgtttttaacatttgatcacaccatcagtagagctacattccacaaagcaattatgttttgctcagcaaaatatcagaatggaataatatgctgcatattaacaactgtaagaatagaagccatttagaacattttagaataatgattgaggtcatttgttcagaatttacagcaaatgtgttttaaagacccactatcatggagtccactgtgaagtctaagttatgcacatcagaaactacaaatgcacaaggagcccagtattttatcaaaacattaatatcagcactattaaaaaccaaaccttttatccagcaccccctgcttaccagctctccccatgtacaaatgcattagcatttaatgcaatatgctttccttttctttaagggctttatccagatatctagaaagtagtaaagtggtagcatttaactaacacaggagtggcaaacaggtggcaactcccttcctcgacccagaaggacaaggctcatctatcaccacaccctccgtgcagagtacagaagccatcttagaatccttctaacacagtattccaggcaccatgacttagaatttgtgttggcatgccagatcccacctacccgaaggtgctatataaataggctagggcagctaggggaatacagttatatgtcttattcacaattctaaaaggcagttcgtggttgcacaggtctttcgcttccaggtcggatggagtagttagcagctcatcagtgtccccagtaagaacaacaggaaaagctcaataaaatatggaaatcaactctctgaaaatggctgagagtgacaaaattcaaacaggcttgagagaggaatgaacctccctccaagaagggagctaaactctgaagcttcttttatcctagaagtgttccaattctgggcacaagcagcagcctgagaactctggctatgcacctgctgaaagccagttctgggggaaaccccagcagggctatggttggagacttggggtccaagcacatggttgggttttcccctgggatagctttccaattctgagggtaagagacttaaattttaacaaaaagccactggaaggcagcctcaaaataaaaattgtaattaggaaacacaagagagaggggctgtgacaaatatagaagactctcatttgaaaaccctaaaaggcaaggacaaacaacagcaagactgaagcttaccagggctgcaaaccagctctgagtcagcacagtccttgcttcaatgaaggtgatgaacaccagataatctggacaataaagttagctggctgacttcaaaacaattatagttattacgcccaagaaaacagagaaaaagatgaataaaataaatgaaaagaagaatttcaccagataactataattggtaaaaattaataatcaaagagaaaatataaaactaaaaaatacaacatctaaaatgagtaactcaacagatgggtttaacagcaaattagatacagaagataagactagtaaacagcaagacaggtcaattaaaacgaatacccaaactaaaacctaaggaggaaaaaaaaatttaagaggattagagagacacaggacacaatgaatgggcctagtgtatgtgattcaagtcccattcagagaaaaagagaacagggtagaagaaatgatggccaaggattttctaaaacaaacaaaacagcaaatctcaaatcgttcagtaagcgctgcaaagctaagctggccatttacacaaaagaaaaagaaacctaaataaaaggaaaaatcttaaaagcagcaaaggagcagatctggacgcacatattaccttcaaagaagtaacaaaaagactggtagtcattttctaacaaaattgatggaaaccaccttttaagtcctgaaaggaagtagctgccaacctagaattctatcaccaagaaaatatccttcaaaaaaggaagctaaaataaaaatgtttctgagacaatcacagcagaatttgtcaccagcaaacttacactaaagaaaagaaaaatgacctagagaaaaacccaaataaggacgaagaaatgaagattgatgaaagggatgaatgaatatggactgcgaccaaactttggaagttatgaaaaggacagacaggcagtactgatttagccaaattaagaaagatggatcctaaagcagcaacagcagcagcagagaagagagaacaacccattgtgcacctcagaaccctcaaaagattcaggcacgagtctcaatgggcacctctggaagtggggctaatttggtgtagaaggcttgagggatttgggggctaatcaaggaagtagatatgctgaaaggaagcagtaacacatgcaagctttcttaaaaggttatgtgggaggggaagtccctcacagtatgacatccacaggcttcaagcaaggggtctatccagaaggggaagaggacaagggaactcctggggaaagggggtcagagaggaggctgacatagccaggtgacagtctgtagcagcacagcagggggtcccagggtcagagagctttgatggtagcagtggcttggagctttataaccacaaggctctatcttaccagaggccagctcaccgggtatgcaaagcagtcaggctcttaatggctaaaaatctgctaattcaggctatttgaaaaaaattagacgtgtaaaaatttgagtttggtaccagtgggcttctgagctaacagatctcagtctgctatgaagaaataaacaacctagaggccaatatatagtggccacctttggcctctatatgacacttgggaaggagggctaagataaggaatggaaatttggacagctacttgaaaacagatttcccagccctgcaccctagcagaattctgaaggactgttcccctaaaaacatcaaaacaggtctgtgctgtggactgaccagccccagaccacaatgcagcaacatgaggcaacagaaggcattctgaggctggtcccaccatgccctctgcccctgcagcatctttttaggtgaaactaatgcagaatgtgctccacaaaacaaggcagcaaagtcagaatgaggaagacctgagatgcagaaaatgacccagtggaattccagagatggcagaaagagggaacccgggctgacagctgtgtacaggcctagaaagccaccaacccaagagaagaaaatgagtcctggagaagaaaatgggaacagaaagataacctactagagctgagctgagtcagtattactgagaggctattgcaagaggagctattgattaaggcgaggcaagtactgacttcaagagtaagttagtgaaagtgaacataccactctacacagctctgcagtgaataatatctgcataggtataaatccaaatactgactaaattaaacttgtaacatacccactctggaggatgaggaaggggaaccagagagaaaatgaaaagctaaatcctcactgccataattagaaacctacaatgatatctacaaccaattaatcaaagatagcagaatttgtatcttatttagaaatgtggagacgtagtaagtcccagggaaaaaagctgaattaaaagtagttgcctctgcacaagttagagcagggaactactgggttttcctatttgctatttgactttttaaactatgttttcatttcattagatgacataaaaattaactttaaaaacacatagacatgaatatttttccttagtaatatgaaacttacaatgctcaaactacgtaacactagcatctataaaacctacaggaaaacagctgatcattttacatttaacttcttttaatataaagagagcttactctcctaaattaagccaaaactcccagatctctcaatttttcatggtgccatgggaaaaagcaaatctgatgtttctaccctcaaaataccaaaaggattaacatcagctaatttcttcaattatgacttcatgagtaacggactctaagtcctggacagcagccaacatcctgccagatgctaaagacagcatggtggaggcctgaaagagaactcagaatgaggacatggggccgggcacggtggctcacgcctgtaatcccagcactttgggaggccgaagcaggtggatcacctgaggtcaggagttcaaaaccagcctggccaacatggtggaaccctgtctgtactaaaaatacaaaaaatttagccatgcatggtggtgggcacctgtaatacctgttactctggaagctgaggcaggagaattgcttgaacccaggaagcagaggttgcagtgagccgaggtcgcgccattgcactccagcctgagcaacaagagtgaaactccgtgtcaaaaaaaaagaaaaaagaaaaaaagaaaaaaaagaatgaggacatggccactgactggtgctgagcaggttatctctcacccaggatggggaccccacataccattatctgctctcctgcctctccgggggctcagcaacactatggcagtggactttgaattacagagcagaaagaaaggttaaattcttggacttgaataaagagaacggcagggtaaactctaggagtttgtagggggaaagtcagcaagtttgcgtgttaaataagggtagagtacaagacaactatcccagtggctgtaaggccaaagaactctgaggctctgtaatgtcggaagttgctggctctctgctatgcaaggtaaccctacccccaccctctaccatctcacctacaaaatcatcagtaaatttatctggacaaagatacctttgtaagagtagaccagggtggagtgaaggtgacaaggactcacaaaggttttgagtgtgaaacttaggtaagagagaaagaacagtgctgagacagcccctgagcatgatggatccagggggatggaacttgtactccatggaattagaagtaagtatggagagagtttgggacattgtggccaatggaaccggtgtacctaagaaggctaggggatcaagatggaatctgagatgcagaatccaatgtataatttcgggataggtgagtgtgtctttaatgttttacaaaatattagtttatcaaagaacacatataaaaatgggttccacgtcaacgaggtctgaaaacatgacatagtatacccttttcatgcagagtcacggtgcacatgagaataacacagtcaagctaaaatgcacaccacaggaaagaaaatgcttcaaccctgaataaccccgcctgccccaaatgtgaccttggaatctttttaactcagaatacacatttaacatcttgtatacacagttgtttactatacatgttagtgaaaatgctggcataggaaattatagtgggaattcagagagagataagttagggtttttttccttcacaatgaaaattccttcttctgactatacatataaatagtacaccctaatgctgctaaatttagttaacatgaaaaattctagagaagaatgtaaaattcacccacaccaccatacacaaagataaaccaatggcaatgtttaaatgtattcatacctagattttttggtttacaaagtttatttgggccggcgcggtggctcacgtctgtaatcccagcacttcaggaggccaaggcgggcggatcacgcggtcaggagatcgagaccatcctggctaccacagtgaaaccccatctctactaaaaatacaaaaaaaaaaaaaaaaattagccggacgacgtggcgggcgcctgtagtcccagctacgccagaggctgaggcaggagaatggcgtgaacctgggaggcggaggctgcagtaagcagatatcgcgccactgcactccaacctgggcgacagcgagactccgtctcaaaaaaaaaatttgatttttttctaaggactccgttcacagtacacagtttttcctttaaaaatatatcacagacgtatgtggacacccatcctccaatgatgtacattcagactatctcaatgggaaaaaaaatgaggcttacattgtgtccgcaatttattcttccccgtgggttcttggtcttgctgacttcaggaatgaaggcgtggaccctcacggtgagtgtcacagctcttaaagatggtgtgtctagagtttgttctttcagatgcgtctggaactttttccttcccacgggtttgtgctctcactgacttcaggaaggaagctgcaaaccctcaatgtgagttatagctcataaaggtaatgcaaacccaaagagtgagcaacagcaagctttattgccaagagcagcaaaaatacaaaacctctgcactacctaagtggaccccatggggctcccaccgctgactgggtggcttttgttcccttatttggccccgcccacatcctgctgattggtccattttacagagcgttgattggtcccttttacagagtgctgattggtcccttttacagagtgctgattggtgtgtttttatagagtgccgattggtgcatttacaatcctttagctggacacaaaagttctccaaatccccacctgacccagaagcccaacttggcttcctcttttaatattgctattgactctattctgcccagtctgggtaggcgccaacctctcaggtgaaaggagcacaagagaaggtaaaggctgtcttgacctgtagtgacccaacaccaggtcatccacaacagggagaagaggtactgagaggggccctgcaaagtcctggtttatttattccgttggtaaccatgaggcagaggagacacaccaggcagtgccccaggaatcctcaagctcacagctttttcaacacatttccttttctttacaactggagtctttctgaaagttgtcttctgcacaaattgctaccaaaatcctcgccagtgtctctcccactgcaggcacaagaccagcaagccttatcatgtctgtgtctccaagtatcttgttcttgctgaccaagtcatggttttctaattctactgacacagtacattctatttccatcatcaaaacccatcagacagatgacagatctgcaaacaccataatggggtgattatacttttatgactagtttttgttgttgttgttttgtttttgttttttgagatggagtctcgctctgttgcccaggctggagtgcagtggcatgatctccactcactgcaagctccacctccagggttcacgccattctcctgcctcagcctcccaagtagctgggactacaggcacccaccaccacgtccaggttttttgtttttttttttgtattttttaatagacatggggtttcactgtgttagccaggatggtctcgatctcctgacctcatcatctgcctgcctcagcctcccaaagtgctgggattacaggctgagccaccacgcctggctttttatgactagttttaaatcttctttatcctgtttggagttatatttttgtattgcattctatttgatcatacgtggacagtcctactttcctttacttggccactgccagatagctctttgccaatgccctggtctgttattttaagctatttgtgtttgtttgtttgccaatagtatctatctgatttttgctttttaccccaatctaaaagtgctgtcttttaatagaggaaattaagtaacacctttagcgtggtagctaacataactgaattatttcctagcttatttactatatttccttaatttttgtttctctaattttcctgtcttttgctattttgttcaatttttgttgtttgctttttctaatgatttggaaattatatatcaattttctaaccaaaattttaaatctatgtttgaaattatatatctaataagtatatatcaatagcatagatatctatagtctctatgcaacatggcaaaattttctacctcaacctgcctcccagattttatcaaaacaaccacattagtgtcaacaattcaaacttaactttatgtttcattggtttaattgcttacttctgcagtatttataccaatgcttcctgtttatctttaataactaaatataattattaaatttatataattctataaattattgaatttatataattattacataaagataattgattattttaataattaaataattgatttattttaataacaagtaaaggtattaaatatttaataataattttcctcatttggcttgtgcactacaagtcatttcctttattcagaaatggtatgcagaaatttggagtccactgtatttctgaaaatcactttcatgtacccattcacatacatgagcttagaaatcttgcatacagaaagcctagaggaatcttgcttaacaacctgttccttctaaaatatgcaaatgttgctgcattatcttctagcatttgactttatggattaaaatctagtattaatgtgattattttctgtagcctgctttgtcttgtttaacgcttatctttgattttttttgattactgaaattcagaaaatgttctattacatgaatcaaacctaaaacaaaaacatctcctatatgcctgtctgacgtcttacatgtatcttccatgacctttagcttttctctcctaatttccccatcttgtctcattcctctcagttgaaaaatagatcccccaggtgatatcctaattcactaatccaatgttggtcatctggtttccttctcacagtaacattttcgtgtcctccgtctgcctccactgcacttgacagtctcttcttttgcaatgtggcacctctcagatctcacaggtcataagccagagttgttttgaagttttattccatttctctgtttcactgtgtgccatttactccattggcttttggagttggtatgtgatatatcctaaacattcacaaatacttcaaaatgctatgcacactgggcgccgagtggtcagtgtgatgcccaaagcttggggcagtgcattacatacagaagtagaagagaattgtccaatcagaattaaacatgatggctttgacctactgtctgcaggaaataagtgatgagagaaggccaaagaaaactgtagccatgtggcctccagatggaccttattatcttatgggtgcttggtttctttttgttctttgaccctaggtgatttattttgttatatttaaagcaaactagcaatttctgctctataattaaaagtatgtgtatgtctttataaacactgagtatatatactattaattgctgttgttatttttccattctcaaagctttccaggcctaatcgttatcctgcaacaactttcaaagaagtgagagcaatgatttcctctcctccactgttcatacgaatcatggagaagcggggttgaaaacgaagactgcctgagccccaacccccggagtccaacttggggtacctgagatatagccctatctgttagtttcctattgctgctgcaaccaatgaccaaaaactcagtggcttaaaacaatacaaaattatcacctttcagcttttgaggtcaaaagtccaaaatgggttgggttggtaggactgagctccttctggaagctccaggggagagtccctttccttgccttctccagcttccagagactgccctcagcccttggcttgtggccccactgcactcctgagttctgcttccatcctcgcctctccttctctgactctcctgcctccctctttcccttatgagggcccttgtgactaccttgaacccattcagatacccggcataacctccccatctccaaacccataacttcaccacatctacaaagccccttttgccatgtaaagtaatacattcataggttccagcgattaggaaggacgtggacatcagtggggttgggggtacgagtctccctatacacccagaaacctgcactttgaacaagaaccagcagactgcctggtgagaaacaccaaatcacacccactacatggtggctggagctttttcctttaggacactcttcagacccatcaccttaaaagtccgaaaccaacagagtgataaatatcataatataaacaaaacaccatccttgacaatttattaagataaaatattgcagtatgtacctagacctacccagaattcatttttaagtggaaagttaaatgacagaacagaaatgtctaagaatcattggggaaaaatacaagtcaaacccaaagccaagtccactttccacagcagaatcaagatgacaccctgtggagactccgatacactcaaaaaacatacttccatgtttgtttgtttgagacagagtctcactctatcgcccaggctgcagtgaagtggttcgatcttggctcactgcaaccgctgccccatgggttcaagcgattctcctgcttcagcctcccgagtagctgttattacaggtgctcgccaccacacacggctatttttttggatttttagcagagatggggtttcaccatgttgaccaggctggtcttgaactcctgacctcaggtgatccaccctccttgcactcccaaagtgctgggattacaggtgtgagccaccgtgcccagccacttccatgttttaaagcttcacttttccatctgtcttaagctcttttcccaaaaaaaaaaaagtaaaatttctgaattgtttaaatacattattaggaaacagaacttaaaaggccagtcctcttagtacatgcccaaattccaaatgtgtcactatttctataataaatagcgccagcactgacagacttcataatgcagggtttcctgtgctgccattcaccagcacacacaaaagtgagagtaatgaaaatgtcaggaaacggcatcccatttagaaaccaggaaatacaaaaatgcagctatcagtcatccctaaggctggccaaataaaaggttttaaatatagtcacggatcaccagtgtcacaagcaacaacattcactgcacagagaggcagcagaatttgcagcattgaggatttgctgggtggctgatgagatctgcccactttgaacttgctctcaactgacatacccagatctatttttacattagctgtcaaaatgataggtctcctgcatcctatgcctgcactgttaattatctatctgcctatctgtctatccatccatccatccatcttgagatgtctatctatccatccgtccattcatctatcttgagatgtctatctgtccatccatccatccatccatcttgagatgtctatctatccatccatccatccatccatccatccatccatccatccatctatcttgagatggggtgttgctctgtggcccaagctggaatgcactggtgcgatcttggctcactgcagcctcaacctttcaggctccagcaatcctcctgccttagccccacaagtagctgggaccacaggcacacgctaccacacctgggtaattttaaaaattttgtagagacagagactcactacgttcccagggctggtctagaaattctggcctcaagcaatcctcccacctcggcctcctaaagtgctaggatcacgggcataagccaccatggccagccaatatttaatttttgaatttgggactcccacgttggagctgggattttgtacttacatgtatactctctagcacatgtaacccattaaaaacatcacctgctttgctggttgcagtccttcctcccctctgtcctaattctgacaggatccggtagaagggacaaattcgtctgtggttgaaatctacggacagccatgagctgaaactacggaccccgtagttctcaaaggaatacagagaagcaggtatggaatgccaacagggctgtgcaatgcccgatccgggccggcgtgagggcacctccatgatggggtgaggatgagggaaggagtcccagttcaagaagccgttaccaaaaggcactcctagcgagccaggtggcttcattcatccacgcctgatgtaaagccacccacataccccatctatacaatagggctgggcgcagactttcaaatacctattgaacctttacttcctctgaaacccagaagcctgtgttacagacctcaaccaccacatacacattgtctctaaggagaaatcaattccgtggggaaaacctgggaatggaggaagcggaaacaagaaagtgggaagtggggaaaggcaagaaggctttctttcagaaggtgagttagagataccacctgtctcccccattgataaaaggctcctcccatggctggctccactcatcctgccagcctcatttcaaaggccacaggctcagagaggtccctgctgagccccgagtccacagcacagccctggcccctctcgatggccttgcagttttatcttaaacatgtatctctgtatgaaatggtttccttattttttgcctgtctctcctgctctaggacgtgtactcgccaggcagaggcctggtgtgtcttctccaaagcagtatctccagctcccagcacaggcctggcccatagcagggactatgatcattatgaatgcattgagaagccaggcatggtggcacatgcctgtaatcacagctactcgggaggctaaggcaggagaatcacttgaacccgggaggcaagcagaggttgcagtgagccaaggtcatgccactgcactcccgcctgggcaacagagtgagactccatctcaaaaacaaacaaacaaacaaacaaaaagaatgcattgagagatgggtgggggaaggatgggaggaaggagggaggaatggaggtacacccatcactcggtaaaacaaggcctaatctgacctagatttaattatcctggagaccacccactccccaaaaaagggccaatgaccactctgagtcggatggattgacataaggagagagaggcagtgtccaatgaaactgtgctagagatcctcatggtccccaggttcctggtcttactgacacggctccggtgagctcccaccctcccagatgtctttctagtaactcctttgtgcgtagctacccaaagctggtttctgctgcttgccctaaatataccccattccaggagcatgtattcagggtggctgaggcacactgcgggcccaaactgttttcaagctttacatctgggcactctacctgtttaatcctcacaaggacctaaagagggaaatgcaattataatctggtattctaaggataccagtggccgggttacgtaaccccgggtaaaatcacgctggcagtaacaggggagcctcggtttatacccaggccataaatttccctcctgcgatgccacgctggcccctgcacgtatggtttattgtgataagtaaagaatcctatataacttatggtttttatgaatctaaaattttgatgaaacaggtctgcttggagtaggatccagctgtgtcattttgaatcttgtacaactgttagactgctttgagtcattctcctaaaactgtaattttattttaaattatatttaaattaattaaaaatataattttataacttgccccggagacattttacagacatgcttttagcaaaaatataacccacaaaataaaagttactttgtgaaaccctctcccaaaatttatataacatatataaccatttttcttaaaattatttttagatctaagcaatggtaaactcattagtctgttcataatatgattttatactccctggcatctgcaagcacagaacatagagaactcagcttgaggaaaaacagtaagcaaattaaaaagtaaaataaatcttagcctatgttcacacactcaaaatttaaataacagtttttctaggggaaaggagtgggaggtggaggcagagagatcaatccatttgcctctcactccaggtctgagaaccctcattttctattcttcaaattaatgaaatgaacacaagaccactctgatgaggaagtctgaaataatggaaacgccgtggcatttgcattccctttcaatgtgaacaggctattttgatagttagcaaaaccaggacaaattgcctgagatttcatcctttgttgctctaaaatggctctcgggctgtaataggccatatcactgcaaaatgcacttacctttaaataggcaggcaaagtggattgtgttaaatataaaattagtgacatgttctctcaactcatggagtctaattctaattcaaaagacttctgctcacttcagacaatgcctgttccttcttgtttataacctcaattccaattttctgcaattcaaataaatcccacctacagccctgggctttggtctcacccacctctgccccagacaccaggctcagactcccaggccctctgtctgccccgcacgcctgccatgtctgagctcttgagcatgggtctgtactgcctaggaggctcttcaccaggtttccacatcacggatgcctcgtcaccatcctggcctgggcttaaacgtcatctcctcccagtggcttggcctgaagaactgctctgatgtcttcttccccacatttgcaccatgtttgatcatcttactctggctggttagtgctgttcccatcagaccctctccccaacactgtaagctttgctgggatcaggaccctgggtccccagtgcacactgggggaatccggctgcagctggtgactcaggctgcaggagcccatgcccagggcagtgcccctgaccagtggctagaaacagcatggcagcccacacctacagggcctggcagacacctctgtcccagcatagcttcacccctcccctcctcccccagctccctgctgcagcctccccagaccctgagatccacgcagctgtgaggagccctcagctctccctgcaggcctggagttggccggctccactgctggtccagccctggctcctgcctccagcctcactcctgggcatctacccccaacaggcaccgggtataatcacctattctctacctgctcatcgcacgcccacctccatctgcaggtctttatcatggtgtaaggctcccctgggtaaagttctccatgagcataagaggcatcttttttacaactgaatcccagcacaaacaggtctcaatcacaccactgccctctcatgagccaaggaacctgcctgggccagcccccgacggtcctggcactctgtgtactggacccagccccagcactggtggctgtgactgtctcctccccacagcatcacaggtgggtgagtgtctagcctaggagggtaggtctcagccaacctcagttcactgtgtcttcaggttgcattttcattgtagtgaatactcagaatggaataatgcaatgaagggctgtgtcctgtttcaaatggaccacaggtgccccttcccagtttgctcctttcctttttgaactaatggtagaaaattccctttacccttagaaactcaactccaacagtgatttagctacattttattcttaaggctgctcatagtaattcacatatccatgagagaaagaccaatttacttaatggtacaaatcttattccccatcacataacacagctggtcaaaaatgcattctttcaagccaagatgaaataattcccagaatgtcccttttagtcaaatttggctcttgacaagtctagagagaatccccataataggcttcaaaggctggccccacagcccccactggcagctggtagggattcccagtaggggaagcctccccagaccccttctctgctactggctgtccctcaaggggtctcaaggtctctcagacaccaaacacagactcctccatgggaaaaaaaaaaaaaaaaaacagctaccttctggccctaggatctgtgcattctcctttcctaaagcgaaccaccctcatcctctcataaagaaccaaaaagcacgtcattcacctgatggctctacaccaccaaccctgttactctattcccatgccctgcttctatgtatttgttgctgtaagacttcttactacccagcattacattgtcaatttgtttgtctgtctaccctctgtctatcctagagaatgtgagcttagagtgtacaacagtacctagaaacggatgaccaaggaaatctgctgaatgaactaacgactgtgtggttaccgtggctctagctggcatgccactttaggatatatcttgagttttaggaattcaggaattcctgcaatctttcaaagggatcatggggcttccctgattgcagaattcagcaatctatgagcgagtatctatgcatttcattgcctctgctttggaagagactgttgttctgtaataggtctggtattcattaagcctttcaaaaagatgttccctggtgcataggtcaacattgcaaagtgtttccttcgccttcctaaacaagcctcacataagaagctatgtgattactggatgtttgggtgattaaaaccacatccttgcctttcctcagcatcccttcacctgttcagtgtcccacactaatccacagctgtgcaatgtatcataaatcagactcagagtctctggaagggtcatgtgctgcaaattacagaatacccagatcacacagacacatccacatggtgcaaaataaaccatgaaggagaaaagaatctcactctcgcaggtttgacctgaagcatacatgacatacatacatagagcacacatgaataaccaaactacttccactggagttaaaccttacagctcatccatgctcctcaagcagagatcagaggacactggggcagggcagggcggtggcagtgcacatggagtctcacgaagcttgagaaacaatgccttagacggtgaaaaaagtcttgtgttaaaaactaacatttcaaaatggaattttggtaaaacaatcaagaagaaagcatggcagaccatggcccgagtgttaggcagactccaagactcgagtttctcaaaatgggagtttgtggctcccagggaatctcagctatgatccaggttgagaaactgctctaaacccagtgagacttgtttcctgcaactatttaactgtggtctgttttgagagtactgtacacctgttttcctttcctccccattttcccctcttccctatcactctccaggctgcgccctactaactccatcctgcttgacaaacgtgtttgcttctttcagtgacttttccctcccattttcttttttggaaagtctgcctttgtctggcatttgtgtttttaagacagcaagaaacgtgagctcagagatctgcatccactctgtgctccccactggctccggggtgggagcagtcttcccagtctgcaaaccctcaaaggggaagtaatataaatttcaaatgaggacaccctcctaaagaagcagctggacccacattttggtacatctgcctggcactcccaggaatgagcagtggggaccatgtttgaccagcatagtgcatcctgggtgatgcttggggcaaattttcagcactgcttgtttaatttttatgtttgttaatatcctttttaggggatgataaaacttacccaagccttcaaaccatctttatagtgtagttttataaattgttatttggttctaatcaaactctgtgggagggaaaggtggacataaaaataaggcccttggattctttcaagagaatgttgctgcatatatatatacacatatatatacacacatatatatgtatatatatacaatatgtgtgtgtgtgtgtatatatatacacacacaaaatgtaaatggaactctaaagatgctctttcactgtggttgaaagtaagtatcacatctgggtaagcaactcatcccagtttgccctggagttttcggttttagtgctggaagatggaagacctccatcctgggaagtccctcaggcctggttgctcatgctatttttatgaaacatgacagcagagcacaggcatctactgagggaaccattaagccctttgctactgatgagtcaaccgatgtactagagcagccaatggcaacaaagctagatctgggatctgggcaaagtagaactcaggtgtacaaggaatgatcctatctggtgatttcactcctggggtgagaacatgcagagttcctgccattccatcgggcagttcagatgtcggagatcttgccatttgtcattttctctacaatgtcaggaatcatattgtaaaacacctgacactgacctggagaagaaaaatgtagctgtttaattcatgtgtaacatactcagattatcttatatgttagcaatactccattaggtctcgtctacctgcaaagagccctgggtcccatcgctgaggaagcgcctctactcaccctccagaggacatggacttcctgaaggaaaacagcactgcccatctggcactggggtcaatcgtttttaaactttaagagaactttttattccccaaagacattcctatgcagaatctaatatataaaacagacaaaagtggtgttctgtgagcagagatttcttttataagttcagatgtaaaatatgtattacatattcagtcgagaacaaaaaggttggaaactggcattatagagggcagctgaagtcataacagcctacaaaaatcatctacttctaaatttaattttggctgcccagtatcaagaaaattctggaaacaggttttactttgtaattttaggataccctcaaatgaaatgcattcggaagcttgaaaacaaaatgcaagggaacactgatgccaatgctgaatcatgaagagaaaccaataaatgacttctccactcgtttaagtattaattacttgggagaaaatgtttttcaaacgtatctgtaacattacggaatttccaacgatgttatattttgaaatatcaatccagtctttagacagaatttcaaacggtcatatttactttgttttccatgctgacccctaacctcctgtccaagaactcagaaggcccaaaaagatcaaatggacaggaggtgggggccaaacaaaaatgacaatacaacttcctgcttcaatcttaaattgtcttttagacgttacattccacttcattagttatccgaaaccaaagtccatgaagctgtccctgacttttcctatcccttccgaacatctcccactagtgcaaaaggccagggaagaatcaggtcattgaaaagaaatgatggctttttccagtaaacaatgatttcttaaagcctaaagtctacaatggactataaagctttccctatcaagtacataagccaaaggctcacatttaaagaaaaaaaacataactgcaatattgttgcaactagctataaaatgtaaaaatttaaaaagtaaacgtctaaattactaaaataagctgatatttagattctaagaggagatcagtaaccatgctcaagatgatcctaaaaacactgtcttctattaattggcctgttttaaaagtaacagaacacttcatataatattgcatctccaacttctattcttattcaccattctgaaactagactgagaggttggataattaataaaatcacccctttcccctggctcttgattatccttcatcagggtcatgtttgtacttctcttgtcgattgtaatcatttatttgaaacagtgtctcagcagttcattagcttttcattagtgcctgtaggttggataaaatgtgcttgaatttccaaagtaaatgcaaatccccttggtaatccagcaaggacatgaattcccagaacattttcaagtaagacagctccaatcagaacttggattttagtgaaaaaagtggtgtcctcctgaatggcagagaacccacgctcccatccagtcctaaacatcaattctgaaaatgaccatcacagtttggcttcatcttcaacctgaccgtggtattcaggaatgtcagttacttaattacaaacaaggagggcaagtcaaaagaattcaacacaaattttaaaagccaatgtatcagctactcagtaagttaaaaatatggctgccaggaccccacctggacagtcaaactcagcagctccagccttgaacacaagagacctggatccgcatcctgcctccggccctgggcagctgtgtagacctacacatcacaagctgagcttggtgtctgtatcttcaaaaaaggaaagatgatccacagttctgagactgggatggagatcacagaaataatgaaggggaagtgccttgcactgtccccaacacatagcaggcctccacaaatgaccgctttacaaagatcacagatgcagcctccccagtgttaaagtatgtcctcagtggacagtcaaaatggactccccgtggctaactgacgtgtgcaaaacgaaagcagagccaggtggccatagttgggtgaggaaaaggtcatgttctctgtgttctcagaaatatattgtaaaagtgtcacaggacctccctttctaccatccagtcaaaccagttcctgttgtcagtgctgaaatagagtgtagctggaaatgccgcagctgaccacccagagaccccctgaggccagcccatgaagacagacttgtgatgtcctccttaaagaccatccaacccggcccctgtacctgaatccccagctatcctgtggtttgcacctttatgaccttctatccccagtctctccttggagtacatttttgttttttgctgaaggctgtctctcccaatcttcagattgcttttagaaaataaagttatccttttgcctccgcagatctcactggtcttttgttaacacccgtaagggaagatagaattgcaggactgaaatgcatgccatgagacagaggaacaggtcaaacaggttaaacagaaacacacatgaaacaaggttatgtactaaccagttgaggaaaatgaggccagaggcaacaggaacttaaccatgtacatgtgtatttcccctgaaggcaatggctcagtattcactaactgagtatccatgatgacttcataaaacaaaactgctgcaaatgatgagaactggcaatacatatatttcctagttctgtcccctaatagagcatagaagcaatgatacccaatagtaaggagctcaactagcaccctggttttctaataccaaggcttcagacgatccaatcactctgagctatgggaggacattctctgataaaaggagaaacacataagcagctgatggtaggggcagggaaagcatcagaatgtaagatgaaccaggagcatcttatagtgctagaaaattggaattacacacacacacacacacacacacacacacacacacacacacacacacaaacagtagagggtgggagaagatgaagcaggagccaaatggccaaaggtcaaataacttgagcaacaaaataaatacccacactattgaattacaacctaaaggccaaaataaatagacaggagtccatattaatgtcacaatgactaaattaacaatggaggaagagaccaattttccttaaaaaagaattccaaatcagaaatgtgaaaaacaaaggagggaaacagaaagtcacccccagaacaccagggtgattgctgctgggcccagatccactctagaatgctaacatcagtgcttgaaattttaagaagaaacaggacatttgcaaggcctggaagtatctcccccagaatatttattaatcactatggctttaactcacgtccactaattctttgacacgctctcccccaggaggcaaagcttaatcctcctcctcttgagtgtgggctgaacttagtgactggcttctaacaaggagtaagggaggggaaagatggtgacttcacagaggagacatctggcagacaccagcttggccaggtgatcaaggttaactcaccagtagtaagtcacatgttgacatcatgatatgatgtgatgaggggggtaccttacctctgtggtggtcttcctcatattcgtaactccagtctaacaatgagaaagcatcagacaaacccaaattgagggatattctacaaaatacctgatccatatacttcaaagtgtcaaggtcatgaaaaacaaggaaagactgagaaactgagattagaggagattcaagagatatgatgattaaatgaaacatggtaccctggataaaaagaccattagtagaaaaattggtgaaatcccaaaaaagtctgtagtttagttatttttagttttgacaaatgtatgatggttacatgagatgctgatttttgagcaactccccgcttctgtgttaaatgattaatacaggagtcccctcacttccttttcctgttctaatgccagataccagccaaagcacatcatttttgcatcatcctacatgtggggaaatattttttattctgcatatcatagaatagtatgcattgatcataaaattttctgcagtagacttgagttaacttttcacctataaaattacaaccctcactcgtttccaacattagcatgaagaaaatggttactcccaggtttccacatcttactggagaaaaccgcaattaatgtcaccacaaatatccagtttccaacgttagctcagctgccattctgtgtgttcctgttcctcaatcatactcaattcacctgtggttcccgtcctgcctctcaccacagggtcggctgggcccaggatgacaaggggcctccctgcctcttccactgtcaccatcctctgcctcagggctgccatcatcgctctccctccttttcctgaatcccagcaccactggctcctccagggcccgctccaggggttatcccctcccctgcctccactctgtctctactcagtcctcccacccatgagcaaacacagccacactgtctccccatcccaaaaaagaacgttcctcagttcctcaaaacattaaacacagaatgaccatatgatccagcaattccacttctgggtatatacccaaaagaacaaaagaagggagaggcatgtgtacccccatgttcacggcagcattactcacaatagtgaaaaggtggaggcaaaccaagtgtccatccacaaatgcgtgcattgataaaatggagtccatccacacaatggagtgttattcagccttgaaaggaaattcagacacatgccacaacatggatggaccctgaggacactgtgctgagcaaaataagccgatcacaaaaggacaaatatgtgtgactccacttctgtgaggtacctacggtagtcaaattcttagagacaggaagtagagtggtggttgccagagcctggggagaggagggaatgtggaattcgtgttgaatggtgactggatacagagtttcagttggggaagatgaaaagcgttctgtggatggatggtggtagtcatacgaaggtgactaataatcccccaaatgcccaatcccatcacccattctcagaactccatggcatttgacactgctaaccaacttctacagcattaagcccgctgctccccagctctcgttctgcaattgttgagggacagttatgcgcacgtgtgtgtgtgtgagaatatacgttatgaattatactgggtgtgcatttatgtacatatatgcatatagacgatatttttttaattccacttactgaacatctactaccattatcagaaattacacaagtatttacatgcatcatcccatataatccccccaaattgccctgtattgcttcctgactccatctacaccatcaccagttttttcttggtttctttgctggcattgtcatatggtggagtccttggggttctgtccctcctcatctgcccaggtgagctcacgcactttcatagctcaccgccatctctgtggtgatggctctgagtcttcctttccagtccaggcccatctgctgagctccagacaccacacccatgtgtccacccaacatttcccatgagcctctcaaagtcaggacagccaataccaacccagttctctctccatccctccctcccaattcctctccagcatctatgctccttgttttataacctctgttgctgttgtccccctgaagcaccaagggaaaggaaaagcctcctcactgggattcctaatggaagcgtttgcacacagtgaccctcccagcacggaccccttgttaatagatgggtaggaagcaccaggaacagagtatgttcaaaatcagataagcgttataaaaactggtatggggtcagagtggagatcattttccaaaccaactattcgaaccaccccatcgccatctgggtaaagactgggttgtgcctccagcaagctactctgacttgggaagaccgtgtgcaactatctttgggaaacacagccgcatgctccttggctggaaatgatcagaggctctaaggagtgtaaaaagggaacacaaccctgattctaatttttattcttggagaaatcacgttttatttttcatatcaaagagggggaactctgtgggcagagtactctgccgagaaccagttctgttctgcaacttgtcccaatcatcaggaaaacacatgttccagggaagcccccatcagggcacacacagccccaaatcagggcatgctgtcacttcctctcattccctcgagagcccacctggccaaagaggctccagtggcctgattggagggcacatcaataatatggagggtccccgtgccccccgacctggaaagtcagcctcagcgatggggctctcggggcctcttaaaatgggaaaaacagaagatgaaaaggctgtttgcacttgtcagcaatgctggcactgctcactatccatactttaccctccccaattaaaaccacacacttgatctgttcacataacaaagcctcccttagagcccccagaggtgcctgctcccaaaacagcactgtcagggcacagcctcagtcctcactggacagaaaccaggggcagggaccaatcctctctctgtcccagccctttcaaaccaaagacagcgtctctgcgaaggagggaagccgcatgttttcatgctgagatacagtgcagatttatgatcggcacctgtgaggtcctcaggtacctcttgctggaacagagcaacaggtttctaaaggttctggcccttggcctctacatttgtcaccactcctgtggtcactcttcagtggaagttgctcaccagcctccttgtcccacatgtaaaagccaaaaggaggggccctacagcaccactgtcattggaatccttccaacattccccacccaccttatgcagtgggaagacaaggttcctaccagaccctccaaagcccaggaacctctccctgtgctgacatccaaagatgcccggcgttccaaaacaccagaaatccagggaagaggccctaccttggggatgagtacattaggaaatagccaaggagcaggattaagtaattatacactagcccaccaggaaaccatgacactgaacatcccatggggcccacgggtctggtgggtgtttctcgcccactgggggctggataagtgagcatgagggtgtgccccaagaagtgtccgaggcagagctcaatcctttagaggtttattttgccaaggttgggatgtacccaagcaaaagaaacacaagttacagtagggtctgcggcctgggcttttctccaaagaggggtctgagaaagagcaagcaggaggggaaaaggagagaggggtgcccatgaggcaagtggttacatcctcggaggctttgattggcattcagtgaatctgcatcttacatataaaaagaaggggccgggcgcggtggctcacacctgtaatcccagcactttgggagggggaggcgggtggatcacaaggtcaggagatcgagaccatcctggctaacatggtgaaaccccatctctactaaaaatagaaaacattagccaggcgtgatggtgggcgcctgtagtcccagctactcaggaggctgaggcaggagaatggcgtgaacctgggaggtggagcttgcagtgagccgagatcgcgccactgcactccgcctgggcgacagagcaagactccgtctcaaaaagaaagaaagacagacagaaagaaagacagacagaaagaaagacagacagaaagaaagacagacaaagaaagaaagaaagaaagaaagaaagaaagaaagaaagaaagaaagaaagaaagaaagaaagaaagaaagaaagaaagagaaagagaaaagaaggggataggggaaaagccaagtatgcattcttctcaggctcagcaaatctacattttatataagcaagcatgtgaaatcacggctatccgttgcggggtgcgggataaaaaggaaagtggttttttgcatgactcagttctcaagcttaactttccctttggcatagtgagtctggggtccacagcttccttcttttttttctttttttcttttttttctttttttttttcttttctgtcacccaagctggagtgcagtggcttgatctcagctcactgcaaactccgactcccaggttcaagcgattctcctgcctcagcctcccgaatacctggcactacaggcgcccaccaccatgcctggctaatttttgtatttttagtagagacggggtttcaccatattggccaggctggtctcgaactcctgaccttgtgatccgcccacctcggcctcccaaagtgctgggattacaggtgtgagccatcacacctggccggcagatttcattttcctttcacaaatgcgtggtctactggacaagccctgagatgaagatggctagagaggctccacagtccctggaggggggcactggcaggcggtccacggccactcaggctgagaccctggctctagaaaagggaggaagtgcaggtaccaataaggtttaaggatggatgtatcagactgtggacaaagactaaaagaaacagggctgccagcccaatactgacaccttgcttcctcatagaatagcagatgtgttggggtggcaatgtgcccaactgctatggtctaaatgtttgggtccccccaaaattcctatgttgaaatcctaacacccaatgtgattgtattaggaggtggagcttttggaggtgatttggtgatgacggtggagccctcatgaatggaattagtgcgagatactgggatttacaagaagaaatatatatctgctcttcttgtttcctggcatgcagctcctaacacttggaatctccaaggtgatgtgtctttttgtgtgctaataagatgagtggtagtgaggggcttctggacagcctcaggatgggggctgattgccaagtgaaccaaccctgtgattagagcgttggaactttcaggcccacaatcccaccaccacccctcaccttagggaagggaagaggggccaaaggttgagttaatcacccaacaaccaatgatgtaatcaatcaagctatgcaatgatgcctccataaaaacctaaaataactggatttggagagcttccagttgctgagcacatggaggttcctggagggtggcgcccagagaaagctccacacccctttccacaaataagaggttaccctgtgcatctcctccatctggctgttcatctgtatcctttgtaatatcctttataataattgggtaaatgtaagcaagaatgtttccctgagttcttgagccatgccagccatcccactcctggagaagggagttgtgagaaccccaatttatagaccatcagtcagaggtacagatcacaacctgggatttgcaactgccatctagagtggaagcatctgagccctcaacctgtgggatctgatgcgaattccaggcagacagtgtcaggactgaactgacttagaggacacccagctgatgtctgctggagaattgcttgctgtatgggaaaacatcccacacacatctgggcgaccagagaagcattctaaattattgagagtgagggctggaaaaactgtgtttttctatatctcgaacagtgcccttataaattaagaggccgaagagagctagttcgccccttccaccaagtgaggacacagcaagaaggcatgatgcagaaggaagcaggccttcctcagacactgaatctgccagcaccttgatcttggacttctggctccagaactgtgagcaataaatgcctgttgtttttaagctaccgactctaaggcattttgttatagcaaccccacacggactaagacaccaactaacactcctttcccagaccacactggcttaggagtggccatgtgacccaattcagactaaagaggtgaggggggaagtctgctaggtggttcttggaaggtttttttttcctggaacaggttccccacgtttctgtttccaattcttgctgcctggaagacagacacgctacttggagaaatagaagccctgcagtaatcctgagacaatacgcacagagcaaagccaacatgccaaagttggccagcagaaaggaggaggagcctcggtccccagtggcaccatggggtggggagtgagatcatggctttttcttgatatacgtgtatactgtttcacctgtgcattagttttgtatggctgccacaacaaattacctcaaagtcagcagcttaaagcaacacaaatttatgatcttgcatttctgtaggttagaagtcccaaacaggtctccctgtggagactctagggctgaatccattatcctgccttttcccactcctagaggtgacccacattccttggttgtcagccaccttcctccattcctgacttccagagccaggagcatggtatctcttgagccattcttctgcagtcacacctccttctgattctcctcttctgcctccctcttccacttatgggactttctctcacccagataatccaggattacatcccttttcgaggtcaactgaccagcaatcttaattccatccacaaccttaattcccctttaccacataacctaacatgttccagggattaaggcatggacatctttgtggaggggggtcactattcagccaaccacaaattcttacagcaagcaaattccttttgttatttaaaacacaaatcaaataatttttaattaaaatattttaattgaatattaaaaattgggactgtaatccaataaatcaaaaaagaaagtccaacctttaaagcacaatgaatcaagaatgctaagatttccatggagaaaagaagtcattctgggattagatgagaacaggccccttctaccacctctgctgatcagtgggcatgcctttactcataaaaaacagagtacagggagctctgcatagcacagtcttcgccaggctgaggctgcttcccagctcctgtgtgtctgactgggctagtccttcacatcccatgcaaaaggttgaatttttttattttctttgagacagggtctcactctgttgcccaggctggagtgcagtggcacaatcgcagctcactgcagcttcaacctctgggcttaagccatcctcccacctcagcctcctgagtagctgggactacaggtgcatgccactgggactacaggtgcatgccaccagacctggctgatttttttttttttttcgtagagatgggggtctcgccatgttgcccaagctggtctcgaactcctgggcacaagtgaccttcccacctggctttgaatatttttaaatttactttaaaaaatgggcttggccgggcgtggtggctcacccctgtaatcccagcactttgggaggccaaggcaggtggattacctgaggtcaggagttcaagaccagcctggccaacatggtgaaactccgtctctgctaaaaatacaaaaaaaattagctgggcgtggtggcaagtgcctgtaatcccacctacttgggaggctaaggcaggagaatcacttgaacccgggacgtggaggctgcagtgagcgggattgagtgcactctagcactgcactctagcctgggtgatggagcgagactctctgtctcaaaaaaaaaagggcttaagcaatttccaattatttaaatttttttgaacttaataagcccaacaagatctttctcctttctaattaatgctaccaggtgagcatcttgaaaaacagtggcctataggtgggtcaccattctccgttgacacaagccctcctacaacagcacctcggggagggagcctcaatgggctccagtgcttcacctatgatgggattctgtggatttaaaacgaagacacaccactgaccttcaagaatctccctggcagatatctcccaaacattcagtcctgatacaagtatcttcataactggaattcacctacttccagaacgtcaggatgagtacccaggacagctctgactgcctgttgcttaaaaccatgcccaggtcataaagccctcactgtactgtaccctaaatgcacttaagcgactgttttctacagtgtcctagtactgaatgttgacactaacctatgaaactaagtgtcatacttactgtgaggcagagaaaccatcaactgaccacaaggtttgtttcaagaacaaatcgagacgaaccaataatgcagaggctaaatttttcaaatcaataataatacagttcacatgcaagagcttttgaaaactcttccatatgataaatatcacatcacatcggtagagatggaaattagattgctcaaccaggtgaatcaaatttaatccagctttttccatcctgttttctaaatatcttgtattattttaaattagttttgaaaaatcaatctgaaagtataaaagatacaaatgaaatctgggtcttggagcccctgggtctaggagcctgattccaagaacacatttcacctgcagctccaaccaggggtctcttcccaacccctggcctgaaggtctccagcctgggatggagcacctccttccttagaaacaaacactgttactgcatctacatgaaatggctcaaaagagttaagagagaatgttgcgatcactgaagaatggtctgaatgagaaagaaagagtagtggacatttaaagcttaattgccagactcagcttttcccttaatcagggaaactgacctaatgagaacagaggggtctctgtgaagctgccaagctcaaaggaggcaaggcagcataaagagacatctgaaggcaggtgtgacatccaaactaggagaagctcagagaaagaagcaaccagggacaggacaacctccatgaaacgatgtgtttgagctgaggtgctggccatggtgctgacaggggtcagcttggggaggcccagggaggtggaagatgaaggcttgatcactgactggatagaaagacagggacaggaagaagaaggagcttggcaggtgaagtgcaggcacaaatacctacccttctctgctttcggaatgtgatgaatgtgaatgatcaccctttatgtcctttataggacaaaaacctcagcagaataaataaccaacatgttagtcacactaaagaaccactctgaagcacagaagaataagcagagtaagatgaacaagacaaaaactttaatattaaagaagaaaatagaagtttgttacaacaaaattacaccaaacttgttaacagaacaatgtggcagcttaagactcaagactttatttttctcatcctcaaaggtccacttcatggttttaattagacaaacattttgtagagtactataattctctatcttttaaatacacattcacattatggtgaaattgggaaatcctaatatttacttgtattaagaagtgtttaagcagtccctttcctctacaaactcaccggtacctgttgttttttgactttttaatagaagccattctgactggtgtgatatggtatttcattgtgcttttgatttgcatttctctaatgataagtgatattgagcattttttcataggcttgttgactgcacgtatgtctttggaaaagtgtctgttcatgtcctttgcccactttttaatgagtttcttagttttttgcttgtacatttgtttaagttccttgtagattctgaatattggacctttgtcagatgcatagtttgcaaatattttctcccatcctgtaggctgcctgttttctctattgatagtttcttttctgtgcagaagctccttaattatgtaccatttgtcaatttttgcttttggtggtgttgtcatgaaatctttgccagtttccatgtccaaaatggtatttcctgggttatcttccagggtttttatagttttgggtttttacattttagtccttaatccatcttcagttgatttttgtatatggtgaagggaacgggcccagtttcagtcttctgcctatggttagccagctatcccggcaccatttattgaatagggagccctttccccactgcttgctttgcaggtgggggtgtaaattagttcaatcattgtggaaagcagtgtggcaattcctcaaagagctaaaaacagaattaccattcagcccagcaatcctagtactgaggataaacccaaaggaatataaatcattctatcataaagacacatgcatgcatatgctctctgcaacactattcacaatagcaaagacactgaatcaacctaaatgcccatcaatggtagactgggtaaagaaaatgtggtacatatacatcatggaatatgatgcggccattaaaaagaatgatgttcctgcaaaggaacatagatggccattatccttagcaaattaatgcaggaacagaaaaccaaatactgcatgttctcacttaaaagcgggagctaaacaatgagtacacatggacagaaagaggggaacaacagactctggggcctacttgagagaagagggtgggaggagagagagattcaggaaaaaaaaaaactgttgggtactatgcttagtactcaggtgaggaaataatctgtacaccaaacccccaagtcacgaatttacctgtataacaaacctgcactgaacctaaaataaaggttaaaaaaaaagaagtgttaacagctccaaataagtaagagtaactgtccactccctgcagttgttcccactgagcctctggtggccccaccccaatccctatggggtctagaaagagtgccccggtctccctggtccttcgctgatgatggggggtggcagctctctggccggccctcggccctcggccctcgcctctcgcctgttaggtaccctggacttctccacatccttccccaccccttctcgcctctcccacaggagtctgcaggaccaggccagcaggtggctcagctgagcatctgcagacacagcacaccgaccccacagagaaaaggcactcccagaccactgtcacagagagctcatgtcgggggcgcgaggggctgagaggggccagtcacaagtcaggcaagtccatacagggacacagagagcaggcagaggtcagggcagctgtggatgactcggggcgtgactgaaatgcatgaaaggatggttcaagaacagcccagcagctcccctctgcccaccacgggagggtcttcactatcagtgaggaattaagactgcaggcagcgaagccccctccccaccggaaccttgcagggctccctcgaggggccaccactcctatcacagccactgtcctgctcatcccagtgaccttaggggccccacccccctgcaagtcctgctcactggcaagcctagcttggaggcaacgctcggggcaaagccagagggtcctccccaggccttctgtgcagacctctgcgaagaatcctgctcagcagtagatatttattgtattttaatatcagggccaaaagctacagttcgcttttcagttaagtaaatgtgtattcactaaagggttttaaaacctttttcctgaaaaaaatgttctagaccatcaaatgcctttttatattgttaacttttactcatttaaaatgcatgttttctaagccacattttacacacttttctatatagacaactctcaattaattccctaagccaaacccagaaatgtttaacacacactttattgacactaaggcacaaatgatgagtggcctctagtgttacccacaaccatctgctttctcagcagcactggcacctggtgctgacagcccctcacccacccccatctcccattccccatcccagagcaggcaagaggggaagtggatattgggaatcctgagagagcagggatttggggcaagcagtaaccagagaagggaagccatagcccttcaccctcgtcagctcccagaagcctctgaaacaccaggaaggaggcctcatgccacatggtatggaatggggctcaactaatgtgatgtggcgaataagcagaacacgggctgcttggctgtttcatctgcttctgttttcttggtagtatctggcctatcagagacaattataccacaccacagtcacagtcctacctgcctctgagtcctaagtgcagattcttaagaagaacagacgggaatcctttagcgtcacagggtaggtgtgagtctgcgctccaggctccagagatgcttctgcaagcatgctgcccaaatccacgtcttttctgctactgggagctctctcatctttaaaatacagaatgcatttctcatatctgaaggaatatatttaactggtgtctcaacataacacttaaagcaaaacccaaaagcagagggtggggggttggggggagtaaagagcagccatatcccagtggaggggcaggaggaagagaaagaaggcctcaggagacctggtcaggccggctgagcggcaggggatgcaggacaagcaggcagaaatgagtggaaaagctgagagaggccgagaggaaattaaaccggaggaggcagagccaagtaacgagcaaacatgaaaggaaatgcctccctgcttcctgccctttctaaaatcacctcgaggcaactgaccacaaatagtcttctatcacaataaaaaaggagatcagaaatttcccggctgtttagtggcctgccaatgccacaccacagtcaccggccttcactgaacaccccggtgcagggggagagaatgtaataacttcttaagaatctgcacttaagcctcagaggccggtaggactgttactgtggtgcagtgatcacggtgctgcaaggcacggcaggacaatttcacagccctgtcctggaagtggcggaggggaggaggactgtgcctcacaagcagtgtactaacccagggatgaaaagcacacatttacttaactgaaaagtgaactgtagcttttggccctgatattaaaatacaataaatatctactgctgagcaggattcttcgcagaggtctgcacagaaggcctggggaggacctgctagctttgccccagcaaatacagagcatagacacccccaccggccagagtgccctgggctgggctgcacacttcctgttgatttcttgtccaattatctcaataatacatcctcaaggaaggaagtggagaacacacagaaaagaagaaaagaaataacgtatatcaccaccaggaaataaccactgctgctaatattttgatgtgtttccaatcagactttttttttgtacatgcacattgtacaaaattggaatcctactgtatagcaggaatcttgctgtgttcatttaaaataacatgagaccttctccaggccactgaatattctttgaaagcacggttttaatggccacagaatctgggaatgacatagtataaccaccctgctattattaagatattcaagctgcatccaattttcaactatgataagtaaagcttcagtgagtctctttacatacaaatgatactgacatctccgattttaatataaacccttagaaagaggatgattgagtcaaaggtcacaaacacttcttttccagaaggttccatcacttgacatttcctccactggagtatgagagtattcatcctccagcactcacccatactgagaataattatgagactgcaccagtttggtggacccaaaaacaaaaaagaattttttaaatttgcatttctctgattacttgtgaggtttggtacttttctatttgccttttatttttcttcagtgacttgccaactagagtccactgcagattttttccatttgatgttaatgttttcttattgatttatgactgcttttagtataatagggatggattggcaggtggacagcgtatgtcctgatttaccaattctgttgatgctgtttgacacacacaggatgctaatggatgtgtggtcaattgtatcaatctttccccttattatgacttccattgcaagtagagtgtcatggcccttcagcctgggatccagactcagctcccccactcactatctcagtgaccctctctttgcctcaatttccttgattgaacgtgcaggataatgagaatgcatttaatccatatagttagtatgtggcacacagcctcagagatggccccaatgccccccacctcctataatggcattcacatgtgatccctgcaggtccagccagcaggggccagggcctgcgaacagccacggagtgagcttggaggtagatactccccagtggtccctggagatgacgcagctccagccaacacttagtgagatcctcagccagaggcaacctgcaaagctgtgccaagattcctggcccacaaaactgggaagtaatacacattcgttgctgtaaactgctacatttaagggtgatttgctatgcagcaggagattactaatgcattatacacgtaaagcacttagaacagtggctgtggcagatcacacaaaaaaggcctaacacgttgacagtcctcccatggaaagaggaaatccgtctccacctggggtagctcagcttgactgtgtgatttgctctgaccaatggagctgtggcaaacgtgaagtcacctacacacaggagcctgcctcttacaactcctgaaactctgctgtctccatgtgaagaagcccagcctgctgggggatgagactacaaagcccatcacccctgctcaccccagtttacaggcagccatcctgacaatgcagcccatcacccctgcccgccccagcttacaggcaagccatactaaccatgtgaggccatcaatgcacgaccatgaatgagctcagcaaagagagccacccagccaagcccagcctgaatttccaacccaaatcacccactgagtaagtagttgctggtagaagccactatgttctggaatagtttgttacacagcatttgatacctaatacagctgccattattactactattattgtcttgggatcagttacatgatcatacatatttcttaacagtatatttatgcttttactttttaatccataggaaacttatttttgtgtatgatattaggtgaggacctaacaatgttttgccacacagccagttctcccttctccataaaactgcaacaccttgttttcacatattagaatccagagcaggggctcccaacccccaggccaccgaccagtatcagtccatggcctgttaggaatcaggccgcactgcaggaggtgagcagtgggcaagtgagcgaagcttcatctgtatttacagctgctccccactgcttgtgttaccacctgagctttgcctcctgtcagatcagcagcagcagcagattctcataggagcatgaaccctattgtaaactgtgcatgtaaaggatctaggttgtggctccttatgaaaagctaatgcctgatgatccgtcactatctcccatcatccccagatgaaactgtccagttgcaggaaaacaagctcagggctcccactgattctacattatggtgagttgcataattatttcattatatagtacaatgtaataataacagaaataaagtgtacaataaacgtaatgtgcttgaatcatcctgaaaccatccccaccccctccctgtccatggaaaaattgtcttccatgaaaccagtccctggtgcccaaaaggctggagactgctgatgtagagaatttggtgatatcatttccagtgatcatttctattggtatagtattaatagtaaatcttgacccaataccatacagctggtttgttttcattttgtcaggataatactgcatgttctttccactgaggcatggcaggagaaatgctcactaatctgactgcatggaagaggaggggtagtgaagttgctggggcaggtgcaggaggagagggagagcagcaacatgaatcaagagacagacacagtcacagtcaccaaagggatgggggtgacgtcaaggctattttttgtctgaaacagaaacaaaacctgccctaactttctaagtcagtcggctgccaaattccacaagctgattctgagcagggcactaggccctgtgaaggggttggcaaggtgcaaggagcatgtgggacagtgccccctcccaggtgttcacagccgcagaggggagacagtgccacctacgaaaccctggagaaaatatgtataaaccaagatgaacacaaattaatataatacaaataatatagaacggaaggagagcttagaagccccacaggtcaatcatggatggctacttggaggaaagttttcagatcctgaggagtaagatcagcaaagagtggtgtgtgcaaaggcaggaggctggaacacataattcatgtggactcatcagttacttggttagcgtaaaaagtctataaacaggtacactatgcagtgaggctgatgaaggcataggggccaatctgatggaagatcttcagtgttaggtctggtcttcaagagaaatgagcaaacaatgtgtgtttttaggtaataagagtaggaaactacaggttgtgcaccttcacagggccccgtgttcttgacacggttctgtgacatatgcagcattccccagtggctccagcagaaggaactgccttccctagaattctcaaaaaggagcacgacttcccaaaggaaaggaagcacagaagccggcatggttcccaggggaagatgcctgagaggccagccggaccccagccctctcacacatccagtcggaatgtccctgcccctgccatcacttggtgcagagcaggcatgggccagctaagaaaatgacgtctttgcttattttcaaattgtactgaataacagctttgagcctcaacgtttagaaatgaaaatacaagcatgagcaaggtcctagtctaaggatccatccacagctctcaggagagcaacatcttctgtgtcccttgcagagtcttccatggtgggaaggggctgcactgtgcaggaaggcaggccctggccctggtgcctgctggaaaggggcatcacgagagacaggtgctcggggcagaggctcagctgcagtcacagaagccctgaggcttggacagagcctgtcctgtcagcgctggcacccgctgccagggcccagttatactgcctgttcctttggctgtgttaatgagggcctaactagcagtggaggcctcacttccccatcagcatgaagctgctaagtgtcccccaaaacagtcgaaagtgtcacacgggagagacacactcgagagaaacttctgctgccccttgggttccagatttgcagtttgattttgcttgcctccatcaaggaccacacgaaccccaaattccaaataagaacactgcaggccagtgggaacctactgcctgtagcctgcaggatgaggcacggcttcctcacacccgaaccaagaggaccagctgtctcagcccacagagcccaggcctggcaaggagctggagcctgtatgagtcaggcctctccacagaaacaaaactgataggacacatatatcagaggaaattcattatgggaattggctcacacaattacagaagctgagaagtcttatgatctgctctctgcaagaggaagacccaggatagctagcatgtcggtcagtctgagtctaaaggcctgaggacagggtccaaaggcccaagaaccaggagcaccgatgtccgaaggcaggagaaaatgaatgtcccaactcaagtagagacagcaaatttgcccttcctgtgcctttttgatctatctgggccctccacagattggaggatgcatgcccaaactggcaagggcagatcttctttcctcagtctgctgattcaaatgtttatctcttcctgaaacaccctcacagacactatcaggaataatgttttaccagcacccctagcccaggcaaactgacacataaaattaaccatcgcagagccacgggcacggtagagaaggaaagcaatcctgagcccaccaagccccctacccaatccctccagctcttctcaaagcctccctgcccctcctcccaattttggagcttccgatccctgccctggacttggaggtgacccaggagtgatgcactagagataagccaaggtcatggtcacgcctcctctggatcctcagtcgacccaacttctccagcaccataatgtcaaacaatcatagctaatagtacatttttatatgaaaaaggaggattctctgctgaggataacacatgcttgaacacaaacgtttttttctggtttgtactcacgttcactttcagcagaatacgtctcctctgactcttcaggaaaccattccctttccttaatggggtagtattttttccacagactccttggtacattttctgtttgctttccctcacacaaaggagacttatccagagctaggacttgctaatggcaggcgtggattcagcaggtgtccggtgctgattcccacatgttcccaggcgcagagcaagaggaacagacccaatctccagggcaggcaaacttcaccaggccagctgccacacagggttgacaagggattgttctgcacccactgactctttctccgacccatccaatcaacaggggtcccaagaagctaagatttccattatttcctgctgcggggctcagccagcctcccgcaccactccatgcgtccccagccagactatcagtcctggtccttctgagcaacccagctgtttcttaagaatgcagtttcaaagagaccttcaaagatggggtgcaaggacagtcatctggcccatggcctgtggagaagtggcagctctatgaaatcgttggtgtgacatttcctgggagggtacatttcctgggaggagagatgagtcccatcatctgccctgaggacaggcactcttctctagggagcaatgtaagcaaggccagttccaccatcctcatagattatttctcacccttactgtaagaggtcctcaattctccagtcttcacaggtacagtagtttaatcaaactaggagttgtacatgatgttatataaagattatcgccaacagccagttattatccctaactccctcagagactaactacactgacattgagaaacgttaggtgactctgcagggttgtaagccaggagggagtgaagccaaggtttgcatagtgccttggccttctcctgtgagccccacatgcagcacaaacttggcccagaaagcccatggactcccttctcacactctatgtggggaatccaacctttgggaggtgactcttccattaacacagcttctaattcagttaattacttgacttgataggttagttccctttgttactacaaacaccactacctgcaagctatggtaatattatcatgcttcattaaaagttatcaagtgatctactttctaatagaggtataaacacctaaacacagctatttcaggccagatgaggtggcttacacctgaaatcctagcatttttggaggccaagacaggagggttgcttgagatgagaagttcaagaccagcctgggcaacacagcaagaccatgtcacaacaaaaaacattttttttttaatagctgggtgtggtggtgcacgcctgtagtcccagctactcaagatgctgaggcaagaggatcctgtgagcccaggagtttgaggctgcagtgagccacgatcgcaccactgccttccagcctgggtgacagagcaagactctatctcttaacaacaacaaagacagctatttcagactaagcctttaactttaaaaatatgaaacaatgtatgtgtcagttacgattcttaaatcattatgtctgcctgggtgcggtggctcatgcctgtaatcccgacactctggaaggccaaggtgggtggatcaccttgaggtcaggaattcgagatcagcctggccaacatagtgaaaccccatcactactaaaaatacaaaaattagcccggcacggtggcgcgtgcctgtattcccagctacttgggaggctgaggcaggagaatcacttgagcccggaggcggaggctgcagtgacccgagattgtgccactgcactccagcctgggcgacagagtgagactctgtctcaaaaaacaaaacaaaacaacaacaagaaaaaacacaattcttaaatcatcacatctaactggagtcaagtcattaacacatttgagaaatttagcaataacaaaaagattattaggattcttctaagctaacaattctaaattctaactacaaaaccaaatgttctggcttaccacaacagagaataacatccaagccactatcacgtcttttccaattagtaagccattggtggtgtgaataaaacctagaagtcaattttctacgaactctagcaggaagaaaagtgattcagctttacagttatcttctgacctgtttttagtcttcatgtaacaaaaagcttgtcaagttacaattttcttatagtgcctcactatagaacatttattctatacaaatgggattttctcaagacaataactacggcatcaacacgaggatgactgtaagacatcaatattttatctattttcatggatgttggacatgcccaacactatcccattttgtaaatgtattgccttgctctgtgtgatgtttgtgataaatgtagtgtcacagaaagcctccatgactgttatttcccttcattttataaatgccaagtttatttaaacctactgtcacatgactttgttaaccaaatacaactgttgaaactgttctaaaacaatgcttatatcagtatcaacacaccagaaaacatgagttgcttctcaaaaaaatttctgatggcccaaaatatcccaatattttgctcaagaaaggtaatttttcatttgatggtgttgatttttattatgataaaatacacagaaaataaaattttccattttcaccagttttttatttttttatcattttttgagacggagtcttgctctgtcgcccaggctagagagcagtggtgcgatcttggctcactgtaacctccgccttccaggttcaagcgattctccttactcagcctctcgagtagtacaggtgtctgccactgtgccaggctaatttttgtacttttggtagagctggggtttcactatcttggccctgctggtctggaactctcgaccttgtgatccacccgcttcggcctcccatagtgctgggattacaggcatgagccaccgtgcccggccatcattttcaccagtttttaagtgtatggttcagcagcattgagtacatttactgtgtttgcaaccatcaccaccacccatcttcagaacgtcttccaagactgaaactctgcacccactgaacaactccccattcctccctagccccgtccctggcaaccaccattctattttctgtctctgtgggtttgactactctatgtccctcatataaagtgaagtcatacagttattcgtccttttgtgactgacttatttcactcagcaccatgtcaaggttcatccatggtgcagcatgtgtcagaatctccttcctttttaaggctgagtaatgtttcatgacaggtgtaaaccacattctgtttacccattcttccatcaatggacgcttgggttgcttccatgttttagctattgtgaatcatgctgctatgaacatggctgtgcaaatatctctttgagcctctgctttccatcctttgagtatatacccagaagtgggattgctggatcacatggtaattctgttttaattttttgaggaaccactactctcctttgttcagtggctcacacctgtaatcccagcactttggaaggctgaggcgggcagatcaccttgggtcaggagtttgagaccagcctggctaacatggtgaaaccccgtttctactaaaaatacaaaaaattagccaggtgtggtgggccacacctgtaatgccagctactcgggaggctgaggcaagagaatcacttgaacccaggaggtggaggttgcagtgagccaaggtcgcaccactgcagtccagcttaggcaacaagagcgaaattcgatctcaaaactaataataataataataatacaattaaattcctcaagatgaaaagtggtggccaagtgtctggtgtactctgcaagttctgagaatcactaggagtcccatcacaaccttttcagcaaagcaatattctctctgggcatgacccctatgtccagaggacagtgtcaacccaaccaggctctgggcaggtggctgtagcttatcacagaaaaaagaaatcccaccagtgagaaccctctacaataaaatcagaaacagactcctaagatatgtagtttctactcctgttgatagtttttaaaaataatgaagggtaggaagttccagttaatagtgataactcgatcttgtgcacctacctctctcctgcctcctgaaaccttggacacactcggacaagaagatgaggaggtgcctccaggggcaggagagtccaacagccttttcaaagccttaacatggacataggaatggcgactgagatggcaggtacatggagggggagtgacgaggctcaggctgattcccctgcagaacttaggagcctgtgggttggagccactggggccccaggaggcaggctgcagagacacccaccaggctggaaaccaggggttggaaagaaggcttggcccaggcacttccacctgtctcatgaagcactgtgaccacacacctcagaggatactgaaacccagtccctggagaaagtatcaggaaaggttcagcggcccagggctgagttcagcaaccgatcttcaccaggtccaggggctgcttaggggatgggagttttctaaaactgggcatgtggctgcacaattatacaatgtattaaaaaatcattgagccgtagatttacaataggtgaataggacagtctgtaaattatacagcagcaaaactttaaaaatgcacagatgagagagagagacggaagtaaccaaaataccaaggaactatcaatgtggcaagtttttgatttttttttcctgctacccaacaaaatatgagtctgagaacaagataaggtgaattattttaaaaaataagaaatgatttccatgtgacacagcaattccacttctgggtacataccctaaataactgaaagcaggagctctaacagatatctgtgcacctatgttcacagcaggattactcacagtagctgcatggtggaaataacataagtgtccatcaatggcagaacagatatacaaaatgtggcacagacacaccatggaatattattttgctacaaaaaggagggaaatattgacacatgctccaacacggataaaccttgaggatgttacgctgagtgaaataagccagccatgaaacgacacatactgcaagatgccactcatatgagttgcccagagtcatcaaattcattgagatggaaaggagaataggggttccaggggccggggagaagggagatcatgttcaatggggacagttttagttgaggaagagggagtcttctggagatggattgcggtggtggctgcacagcaatgagaatgtacttactgccactgaaccgtactcttaaaaatggctaagacggtaaatgttatgttatagatatttcaccatgatactaaaaaaaaaagataaggaatgctatttttgcacagaaaagaataaagaaaagaaggacagctgagaaacgtggaagtgggtgtccctgcaactgggggcacctgcacagcatggggcaagaacagccactttcattaccagcttctcaacacaatttcactttgactctgttatatactagacagatttttaagcattaattttaaaacatgatggagagtggcggagatgaagagaaaatcaaatcatggaagctacacaccaataagcctgatgtcaatcacaggccagatctgagaggggactatcagagcagaaggctcgtgagtacttcaggaagcaagtgccaggccaaatgcatcttgatttctcttttaataaggttatgagattggcatattagagaaatgctgagcagatgagggcctttatttcagcaagaagttaacacagtcgctcgtggaccctatgaagaggaggcgatgtggaggggccccctgggcagggggcagcgaggccgctcatggcacaacctcggaaacagcaggagcagttggtccagccacagagctccggcccagcctggatgcaggacggggaacttgtttaaaacaggctgacaccatcgggcctgtaccctcagagacgagcctcccaatcaagatgagatcatctcaacaggctggaatgctaacttttaaagcgaacagatgaatttatcagtcttacaaatgttccgcaatttggtaccacaattcattaactgccatgagctgtaggacacagtggaaaggaaaaaagcatggggctttagaggaggagcagccccttcacctgaggcagtgacgatgcggttgggagctgcccaggccatagtggaaaccacccaatgtctgcccccgatataacccccactcagcactggtgccatgtccaaagtgacaagatgcccagaagccaccagatgaaaactgggtgaccagccttcaaatgtgcaagcagaaaaaagagctatgcagggaatggggtgcagaagtggttttctccatttgcagaacttcaatgttggaagggaagtaaggacatttcttggttctccaggaagagccaggcaaacagaatcattgtccaaaaatagatttggctctagttaaagctgcctgacaactgagccacgtgacactgcaagctccccatccccagctcagggaaacggagtgcccacacatcagaaatgccactgaaggactgtgcactctgcagaggattgacttaagtggaccataaacaccttctgataccctacagtaaaagagtaacagtgatgaaaataacaacttccatttgctaagtcctgaccgcagccaggcaatcctggatgtactctaaaggcttcctgactctgagtctttgattctcaaattgtatggtccattataaatacaatcaacaatcaaaccccaacataaagatatttaacataaatcattagttctttgggatgacagttataaataatttttataattctttaaaaggaagagtctatcaagtttataataaaaattgcctaacactaacatttaattagtcctaatacctgaccgacttcttctttcgagacatcagggtatacctaacaatgttcagatttgataaggtctcgaggaagcaggtagctcctttgtttgtggcctgagatctggcattgctgaagctagattgggccaggcctggctctgccaaatactgatgaactgccaggttcattcatttatccaacaaatatttactgagtgccagttatgtaccaggtgctgttctctgtaccggcagagagggcaaccagcccctgaagctggaagcatatggtttgaggatcaggaaaaccaagatgatggcatgatggagcgaggcatgagttcagcaggaagggccagtgagagcagctccgagcaacagtgcctcaaagggcaggttaaagaagaaaggaggggagagcaagaaagcagtgagagagactacacaagagaacaatgatgtctgctttatgtttctgtcatggtcactctggctgctgggtggagatggtcagcagagaagcaggaaagacagaaaagagaccagccagcaaggtagacactgcagcccccaggagagagcccaggagaggacgctgcagcccccaggggaggacactgctgcacccaggggagggcccaggtgaggatgctgatggccccaggggagggtccaggggaggatgctgcagccccctgggaagagccgaggagaggacgctgcacccccaagggagagcccaggggaggatgctgcagcccccaggggagagcccaggggaggatgctgcagcccccagggtagggcccaggggaggatgctgcagcccccaggggagggcccaggggaggatgctgcagcccccaggggagggcccggggaggatgctgatggccccaggggagggcccaggggtggatgctgcagcccccaggggagggcccaggagaggacgctgcagcccccaggagagggcccaggagaggacgctgcagcccccaggggagggcccaggggaggatgctgcagcccccaggggagggcccaggggaggatgctgcagcccccagggaagggcccaggggaagatgctgcagcccccagggtagggcccaggggaggatgctgcagcccccaggggagggcccaggggaggatgctgcagcccccaggggagggcccggggaggatgctgatggccccaggggagggcccaggggtggatgctgatggccccaggggagggcccaggggaggatgctgatggccccaggggagggcccaggggaggatgctgcagcccccaagtaaaactggagctcctccagaggaacagcagcaggggtggagggagggaatccagcctgggtgtgtcctgcggcaaagcgatgggcagggctaaaggaaaaggagaaatcgagatgcctctcaggctattggagtgaacaatggacaagaaaggaagccatgttttaaagatgtgcttaggtagtgttccacccaaagttcaaatccaagtcactgccaaaatgcaaaatgcaaactgccagacttgtggtctgttcatctatcagtaaacagggatgaataaaggcagaacatgcctgttcccttcagaaactaaatggctagaataaagtactgttccatttccagggtggctcagctaaaacgccaaggaaacggccacctgagtgttcgatgggaacacagtgtgagatgcaggttaagaggatgcttttgaaggctgcagtgctttgtggttgggctgtcctagttataggcccttccaaggctgtgtcaaagagattcaatgcacagagaccacccggtgaaactaccacatccccctgctttcatcacatcactccttagaggaacacacgttactctgaggaagttgaacatccgtagcccaattaagaccatctatggccaggcacagaaggcagtgtccagctctgttccccttccagactggcctttctgcagcatgacttaccagccttcaatcacactctgtttctgctcccctgtgcctaacttggggtacccacaacccactgcccttctctgttatccactggatgaaagccacccagcaatcatggctagctccagctctgcccctccctgaagcctcttctgattgttcctgcctccagatgccaaacaaaccgctgcctaaagaccttgcaccacagcacaaggctcacagctctttctcctgcaagtggatggtacgtgccggacagaagacaagctgcttgaaagcaagatcatcatgcattgtttttattcccccaaagaacctaggacagtgtttccaatactgggagcaccctccttccaacagtgatcgactgtaaagccataaatatttctaaatgtatactgaacataattaagaaattccaagacagcaaatattcattttataagctggttctgggggtgggatctaacttgcatcactagaccaccaatggtacctaaatgtgaatgattaagaaaagacaggctgggcatggtggctcatgcctgtaatcctagcactttgggaggccagggtgggcagatcacttgaggtccagagatcgagaccagcctggcgaacatagtgaaacctcgtctccactaaaaatacaaaaattaggcggggtggtggcgcatgcctgtaatcccagctacttgggaggctgaggcaggcgaatcgcttgaacccaggaggcagagattgcagtgagccgagattgccccattgtactccagcctgcgcaacgagagcaaaactccatctcaaaaaaaaaaaaaaaaagcaagacagataatccaaatgaacatttgcagggttgattaaactaattaaatctttaatagtgtctgaagttgcttttcaattattaatttggatgcatttttgttaaacttctgaatatgattttaaaatatagttctaatcattagccaacacatacatttttaacaattatatgataattaaatctgttttgaaactgttgaaaattttcttatgtaaccccagttttcagggcttcaagcaactgtggagctacaaaaaaaatatattaatatgattttttaaaaagttcttccaacgttaaggtaacacacacaaaacctgcacaaaggccaccagagcagccccatgcagccaaatgcagtggcctttcttccctagggctccggcttaggataaggctggaagagcatccgaggtggttccaccccatcccgatagcccccttccagaaatgctgacacatgcaacatccaccaatggatgaacctcgaggacatggtgctgagggaaatacgccagtcacagaggacaaatcctgcaagattctgcttcttttttgttttgttttgtttgtttgtttgtttgagacagagtttcgctctgtcgcccaggctggagtacagtggcgtgatctgggctcactgcaagctccgcctcttgggttcaagcaattctcctgcctcagcctcctgggtagctggaattacaggcgcacgccaccacgcccagctaatttttgtatttttagtagagacagggtttcaccatgttggccaggctggtctcgaactactgacctccagtgatccacctgccttggcctcccaaagtgctaggattacaggcatgagccaccactcccagccgcatgactgcacttctatgcagtacctggagtagtcagattcacagagaagtagagtggtggttgccatggcgggggaggggaaatagggagttggtgttgaatgactacagagtttcagcttgggaaggtgaaaacgttatagagatggatggtggtgatggctgagcaacagtgtgaacgcactcaatgccactgagttgtacacttcaacatggttaagaggatcagtttcacatatgtgtattttaccacaattaaacattttttaataaattaattttttttaaaaagcctcccttccagctccaaaggctacctttgagacagcctcctggaagggacccagcaggtcccccgtaagactctgattaaagttgtaaactgccacctccatatttctatctatagttgaattttctttaccactaaagaagtacttttgtctccttttccacattcagtgcccctgggtcatcaaaagtaagagctaaaagcactgattttttgacaagcaagccacagattcaatatcatgtatgttcaacacagccttgaaaaccgcagaatagatttctttaaatcactaaaaggagcctaagacaagatcaaagaatggatcccaaattaactgaaaaccttcacacacataccacagacagtcacggcgtgtgtgtgaacacgggcaggatccagcaaagccactcaagattggcagaggggctgctcggtgccccccactgccacgtttgttctatgtgtggttgagcatccggagggtcctgaggcagtgccagcccactgaggtcacaggtgaagcccacaggtcctgggccctgccaagggctacaggacactcatcaatcagcaggtgagagtacatttacctgcttcgtctcggggagcctcctgccagctcccttgcaaacttcattcacctcacgcctccctccttcctgccaagttcacctctgttgcaatccagggcaggcaaatactcgtcactcggacaaccagggcccatccttcaccgcggctgccgctactaatcaaccatatggtcttttccagggaagcccagacgcacttcgaaatccttcccagtcctacaaacgctgccggaagccacaatcaactgacaagcactggcagacaaggtgatgcgtgtgactcttccacagcatcctgacagtggccagctcggggctcatgagcctgaaggacgctctgccttcaagacgtctgacatgagacagtccctcaaagatatgctagccctgacagtgagcagttcctccttgattctcttcctagattaattttttgtttaattggtaattaatgttcattccttaataccaagtcacaattaaaaattgctcaagtcacagtcatttgacaaacgtcatgccttgtttcacattagcaaccactattacaggtgatctcactagaccaactcaaaatactggctatggctcgaagtgactctgctaagtaaacagaggtggggcattggaatcactccacattttcctgccgactcctgaattcattaagcagagctcagcccaatgcactggttttttatagtgccccacacagccccagaggatctaggggacattgatggtcctgggtggggagttgctaagtggagagggttgtaatgcctgggccccaccttcatccagatcaactccattttcacatactgagcttcctcataagatttcattggtagaaaaggctccatcactaagagtaaaaacgtttcccaactgttggctaatgcattgtgcagagagtgaatgtgcacatagaaaaagctccaagaaggacttctgaccacacagcggcccctcgagctgcaggggcagccagcatggactgggatgtgctacaaatagaaagtgagggcacaggtggctgagaataggcacaggagagaacagaaagacaagcacagaaaacagagagaccccgggaggcgccgggataacagagaggcagaacagcggctacaaagtggcaggaagggctggcagatccctaggaataaagggagtagcaaagctccaagcaaatgctcaccagagcccatatgcccatcataacccacacggcagcacgggggccaagggccacaaaaggcaatgcacgcatacaccggggtaatacgtaagccccgcacccgccagtaggacagcacacctctggtgcaaaggccctgggtgtttctttgaaaacaattagtcacactgatctacaacacattgtttctcaatcttttttctacctcatgccttcttctgaaaaagaagattctgaacaagctgcaggcagcccacatgcacacgtggagatttgggggccctgatccagcagccccgggagaatcagaacctgcagtccacatgcacaactctctgattcaagatcaatgctgacagtggtcacccaaggaggagtggccctgagggctggggtggagcagagggtggaacacagcagcacgcggtgggggcccagaagggctgggccaagcaacagggcagtgggcccccacaagctggggagaggagcaccccaaaacaatcttcccccaagaaatgcaaagcaggaatcatcatgaggcctcaatgtgctcatgttacagaacaaagctctcctgatggtgttgcctttgttaccttgtctccaactctggggacgcttaaatgctgaagccaggcctgtcatgcaattcacccagcatcagcagggacaattcaggaagaggtggcaccaggaggaaaacagctctggaagggcaggtctcgataatcaaaacccaccttaaaaatggcatcatgatgaactgttcagacaaggcagctctggcttcagtgtgttaatattaaatattttatacacacacacaacacacaacacacacacacacacacacacacacacacacacacacacacacatataaatttgagacggagtctcgctctgttgcccaggctggagtgcaatggcgcaatctcggctcactgcaacctccgcctcctgggttcaagcaattctcctgcctcagcctcccaagtagctgggattacaggctccccccaccacgcccagctaatttttgtatgtttagtagagatgaggtttcaccatgttggccaggctggtctctaactcctgacctcatgtgatccatctgccttggcctcccaaagtgctgagattacaggtgtgagccactgcacccggcctataatcaattatattataagttattttataaattagtgtaataatacatgtgatataaatacaagaatctcccttttatccattttttaaagattttaggtttaagcatacaagtacttacatttgactactagaaagagaataaaaaatagattgtaactatctgctgaaggatgacaaaacagccactggctggtcagtacactcagtcaccagagaagtcttcaaagtagtcccaagaggccagttaggaagggggaaaggaggcagggtaggttcttgagggtgggggaagcaggggaggggcagctcaccagcactcactgtacagctggtttacctgttggacaggacggtgtttttccagcaatctcacttgggaaagaaggaggagcaggtggcccagcttcaccctatgacaagtgtgactttcttgcagccacaccatacccaggctgctcccaccccctcctttcccctctctggctacagctctgactaacccgggtaacctgtccctgggcagctggaatgtgccctcttctatagctgaatgttggtgtctcttttcctggaaaaccataacacttccaacaaaataaggaggccaccgagggatggtggcagctgcagttccccccatgtagaggattccctgcggcaatccagacccagcatgcctggatcttccaattctgcaaaagaattcaaagtccattctgtactgtgaactctcccaagttttaagtgttatcaaataaacatttttaaacaccgcatgagctaaagaaaacatacctgggagcggaaggccacctgtggtcttggttttaggacctctgaacaaaaagatagacttcagtgctcagggtgaacagaaaaatatgtttttgaaagaaataataacttgtcagaaagacgtctactctatgtcacgtcaataccaggcacagcagcgagggaccattggacaccggctgtcctcagttcaagaaaccgcctgaggctgctggcaaattgacctcagggccccggccgcagccacggccccatctcccgggctgaatgctgctgctctagcactcattcatgacaacgaggacatctcaaagctaggaggcccccggaggctccagttcaacaacatacccaaggtcaccccgtgggccacggcagtccggactcccacatcaagctgggcctcctggaagacagcactgaacctagccatggattctgcagacaaccttcaaacccccatctacagccttcaatagcaaaccctgaagcacagtgcgtgctgccctaccctatgacctagttacagacgggcttgcgacggttactaggagtgagagcagaggccctcattgtataaagaccagtgcccatcctgctacctcactgaaatggagggagaaagcctaaatcaccaagtttagagttggtgggcgagaagagaggctacctacggttcagggaaaccagcaaagataagccatccaggctggggcgggggccatccccaccctaccccaagtctcagaaaggctgcgcccggcgtcagggcacccctcctgggtaggggccctgagatgacagttcacacagatcagcccttcagaaaacactgtcatgcttctcaaacacattaaaacacaaatgactacggttcaggttcatggtcaagtccagtccttccatctctccctgacaatctatatgtcctggtcactgcgtggggacttaggtacctccttggccacacagttcaaggtcatttctgttgttgtttttttttcctttggagacagggtctcactccgtcacccaggctggagtgcagtggtacaatcttggctcatggcaacctccgcctcccgggttcaagtgattctcgtgcctcagcctcccaagtagctgggattatagacatgtaccaccactcccagctaatttttgtatcgttagaacagacagggtttcaccatgttggccaggctggtctcgaactcctgacctcaagtgatttactcgcgcctcagcctcccgaagtgctgggattacaggcgtgagccaccgcacccggccaaggtcatttcttcgggggatcttttgtgtagatgtcgtatcttgctcattacatattgatttttcctagttttattcatagaaagaaaccccattttcccaatgtggaagcacctccttatataaggcaaatgtatgaacatttttatcctgcagaaacctgtgtgccctacattgtatgatccagaatagattctggccctccaccataaaaagcacatgttcacaccaaagcaagcaaagacatgcggcactgagcgagagtgtgtgggagggggtgacaagaatggtctgtgggaccccggacagcctttctgggcccccagtcctcactgcacagatgccaataatcactgctgcttccaaggggtgagctggagacagaacgctgagagagtacaggctcacagcaggctgcatctgcgcacgctcttggtgtcatcactactgctggcctgagcaggaaggcccaccctgccacagcggtccctgcacagggctgagtcctgtgaccacagccccattaaaaaatgctctgtgctccatccggctcccttagcaacctcacagggtcccaacctcagagcaggatctggaaggaccgttcactcaccgcaccttggaatgcattcaacttggcggtggcccgaagctgactcccaccagggcagaggaaaaaacacaacccagtgggcaagaggggctgagggaggaggagtagggggcgagggggcagtgctgggcaaaaggaaggggacaccaagggcagacacatccctggatgtccaaatggaaagaaatgaggaggaggaggaagggtcccttgaagggccgtaccatcccgcagaggggacatgaggctgtcccagagaggggtatgggtcctgagaagctagttagcacctctgatgccagccctaatgtccactctccctggtccatggcacaccctctccaggcaggccttcccgagaggagagacctccagagaagcaggatctacggaagggcgagctgacccatggtgacaggtctcctacttccctgcccaagtggttggcatctgtatcttgttcatagtaagatctgctcatgagacaagagccactaagaaatattcacagacaagatgattgcatttggggaaaatgtgacagacctgaagtgaaaacaaaggccaacttacaaaatgtcaagagtccaacaacctgaaatgcaaagcaataatacacacatatacattttagacagcaaattatactcttcaaaaggaaactttagctctaaatttttataactaaaatctgcaattcttttctatccccccaaataacaatgttttaacaggaaactggctatttacataacgtgttcaatagcgtggaaaagcattttgtgtattttattatatgtttattgtttcagaagccaccataaagttgaccacctgccactgccaccccataaaagggaaaacgtctatgtgtagttctattggactcactgggaagccattagctgacccttcattatttttaggcttctgagctaaagtgggaggagaaaatgacgttagaatgcccgttcaccaaacagctactcagtggctgctgctgcagacaccaaggaggtcagcatggggcccacaaagagaaaggacacatccctcttcgtggtccagccaccaaggttttaccaccaccaggcagggccagacctggacatgcgtccccaataccccacctctgcccctgaccacccttgtccttcctggacacttctggacctgaggacagacatttccctcgactgcaaagatgaggcagaaatgacacctggaagcaggggacgagtgagtctctcacacttccctagagtagaagccacagaggtaccaaagtgagggcggagaaacaccaagtgccagcaaggagcggccaaacctctcacatgctgctggcgggagcagacagcgatgccaccaccctggaaaaccgattgccagccacgacaacagttgaacacaggcacactccgtgccccagcaattccactctcctaggcatacacccatccaaacaggcgcgtatgctcaccaaggccacgtacgagaatgtgtcggcagcactgactctaagacccgaaactggaaactaccctagtgccatcaacagcacactggtaggtaagtgcactcatacaagagagcactctacagcaataaacatgaatgaaccactcaacaatacagatggctcttcacaaacacactgttgaaagtgtaagagatcagacactaaataatacatgttgtatgaatccatttatataaagttcaaaagcaagaaaaattaatacaggatgctaaaaatcagaagaaaggttcacctttgggggcagtaagtagaagggagcacaagggggaccttgaggtgcaactgatgttctgcctttgggtgccggctacacagagacattcagtttgtaaaaaacatactgagctatacactcaactgtttgtgcagttctctgcatgtatgttagacttcaacaaaaagtgcaaaaaaaaataagggctgaggagagaaactgttgctaggagacaaagaaatgaagattctggctttggttattagcccttagagcttggagaactgtggatacacgctgaaagcccattaaatttttcaaggaatcttaggaccagagaaacaccaaacctggccatcagtggtctctggtactctgctaccaatctccagacctgtgcctgcaagacatggctgagaaaaagctgcaggcctggagaggggaccctgtccatctcagacatggccggggaaaatggtccagggagatctctatacagaccatgcccaccccatacacaggggagactcaaggctgtacccacttggggagggggtgggtgtacttcacgtgggcatgagcgttcccgaggtgcacgtgggtaagaatggactggatggccctcactggtcaatcactgtcctgcaaatcacgttctgcttccctctgtgaatcactgtccagcagaagcacaacacaagccttgggtgtactttacaatttcctcatagccacattaaaaagaatagaaagaaattaaatttaactatatatatatatatatatatatatatttttttttttttttttttttctgagacggagtcttgctctgtcacccaggctggagtgcagtggcgtgatctcagctcactgcaagctccgcctcccgggttcacgccattctcctgcctcagcctcccgagtagctgggactacaggcgcccgtcaccacgcccggctaatttttattgtattttttagtagaaacagagtttcaccatgttagccagaatggtctcgatctcctgacctcgtgatccgcctgccttggcctcccaaagtgctgggattataggtgtgagccaccgcgtccagcctaacaatatattttcttcaacccaatacattaaaaatattatcctttcaatgtgtaaacaacataaaaaatattcagatgttgtacattctttcatgcacctcaagtctttaaagtgcgtgtgtgatgtagtttggatatttgtccccgcccagatttcatgttgagatataatccctgatgctggaggtggggcctggtgggaggagtttggatcatgggggcagatccctcatggcttgatgccgtctttgtcatattgagttcttgcacgatctggtcatttaaaagtgtatggggcaggtgcagtggctcacacctgtaatcccagcactttgggaggccgaggcaggaggatcacttgaggtcaggagttcaagaccagcctggcaaacatggcaaaaccctgtctctactaaaaatacaaaaattagctgggcgtggtggtgggcgcctataatcccagctactcaggaggctgaggcaggagaatctcttgaaccggggaggcggaggttgcagtgagctgagatcttttgagactctgtctcaaaaaaaattgaaaataataataaaagtgtgtggcaggccaggcgtggtggctcacacctgtaatcccagcactttgggaggccgaggcaggtggatcacgaggtcaggagatcgagaccatcctggctaacatggtgaaaccccgtctctactaaaaaatacaaaaaaaaaaaaaaaaaattagccgggcgtggtggcgggcgcctgtagtcccagctacttgggaggctgaggcaggagaatggcgtgaacccgggaggtggagcttgcagtgagccaagatcacaccactgcactccagcctgggtgacagagcgaggctctgtctcaaaaaaaaaaaaaaaaaaaaagtgtgtggcacctctccgacccccgctcctgctctccccatggtatgcggttgctcctgctttgccttcctctgtgaataaaactccctgaggcctccccagaagcagatgccgctatgcttcctgcacagcctgcagaaccaagagtgaattaaacttcttttcttataaattacccagggtcaggtatttctttatagcgacacaagaagggcctaatacagtgggtgttttccacatacagcagcacatcgcaatcagcaccagccacacatcagtgctccggaaccagctggacagcacaactatgggaaggagtacctgctccccactactccacccctaagggctactgtgaatagctttggctgcaattctctctctccctccctctctttctctctccctccctctctctctgtctgtctcacacacacatacacacacacacatacatacacacacacacacacacacacacatgctgggacctagaataagctgttctatccctctagccacagaggtcaagtcaatgagagatctgccaggaatcttgcagaagaaacagacacttttcccattgggctgaaggtgagagaaaggatgtgaggtctggaattgtagcagctgcttgaggccatgaggtagaggctgtctaggaatggagccacagagagaggagaacagagcccaggaagaaaggaaaagcaatgtggttctgtggacatggctggaacctctgcatcaacagatatatcccctactcttggatttttcagtctcatgtgctaaaaaatttgcttgttcactacgcaaatttgggctgcactgatgtgatctgttattaaaatagtcccagataatacacctcattattctaattatctctgctttttttcccttctagcaactttaaagtttcatattgttgttgaattcttcttactgattcaagttactagtatgcttttaataacatgtctgaatatatctaagcctcaaaacactgcatttcttttgaagctacaatttcagttttaagggctcatcctacgaaaataaccagacaagtgtccaaaaatgtgtacacaagaccattcactatagcaaaaaaaaaaaaaaaaaaaaaaaaaaaacccacaaatgcacactgagaaataagtgggtgtccagtcctaaggagatagcttccctctggcacagagggccccccagtgggcagcgttctttgttccctgcgtggacagcaccctggtagggcagggaggccacaggctcactggagcacggtcacagaaggacgtgatgcaaagaaaaagagccggatgtggtggaaggaagggaacatgcagagagttaggcagggcatggggaggcagcatggggcccactctcccatgtcccagcagagaggaggaacgtctaggagggggagcgggggcagagcctgccaacctggactgctgtcagagcaaacctgtgccagagcaaacctggtggacactggtttagaggcattgaacatcccatttcccgggcaactctgactttccgaaggtgtgagtgggacccagaaaacctcacggctgcagttggggggtgagagtctgggaggtaacagctgggcaatgtggaggcgagacaaggggaccaccatgggaaggaggtgaggtggcccccaagggccagatgggggaatgtgtcaaacactcagaaatcctgcagaggaacccaggggaactgagtcagcgagggaaagtccctagaccataccccagcatgggagaacagatgacagcagtaagcaggtggagaaggagtgctgccttgggggtccatggcaccaaaggatgctgtgcccagagtctctgctcctcacccccagtgacatcagacagctacaccatccctgcttccagatgccattctgaagacgagcctgcagggcaggcagaggctgagaaatctgagaggctcagcactacctatacgggcacttctcaattagaagtgtgcataggaatcccatgggaatgccgttaaaatgcagatcctgctacaaaatatctgggggtggggcctgagaccctgcatttctaacagactcccaggagatgcagagactcctaatggatgggccacactcagagtagtaaggccctcagggacctctgtgaatgaaacagaattaaaacaaccctcccgctctcaagtagatgtaagattcatgcagaagacagactgattatacaaaaaaatagtattaataaggaagacagacgtaccctccacatctgagattagtgtgaatactgtactctgcaactccactacacctacttataatctaataaaaattctgaaggaaacatttataaggcataaagattaaaaatattaaattatatgcttaacatagcctggctaagtgcactctgggggttgaaggcaaggataaggccataaggaaaagagcagtgccttgatcttcctctataaatcaagtcacttagtcctagacaccatttgccttgttaggactgcaatggttctctgacttcacgaataagcggatcctgccttctacccccacatactgccaaacatgacgtttttaaggtttatttaattcatacatgttattatttagggcagattttggttcacagcaaaatggagcaaaaaagggcagaaagttgccatatactccccctctccccagaagcacagctttccccatcagagtggtgtatttctttttcttttctttctttctttttttctgagatggagttttgctcttgttgcccaggctggagtacagtggaacagtctcagctcactgcaatctacacattccaggttcaagcaattctcctgcctcagcctcccaagtagctgggattacaggtgcctgcaaccacaggcagctaatttttttttttttttttgtatttttagtagagatgggatttcaccatgttggccaggctggtctcgaactcctgacctcaggtgatctgcctgcttcagcctcccaaagtgctgagattacaggcgtgagccaccatacctggccagtacatttcttacaatcaatgaacctacacactgacacatcattatcacccaagtccatggtatacattagggttcactcttggtgttgtacattctgtgggtttggacaaatgtataacaacgtgtatccaccattgtagtatcttaagagacagtttcactgctctctgtgccccacctattcatctctccctcccccaaacctctggcaaccactgttctttttactgtctccacagtcttgctttatctggaatgtcatatcttgggaatcacagcagtgtgtagcctcttcagactggcttctttcccttagtaatattaatttaaagttccagatcttttcatagcttgatagctcatttctttttagtgcttagaagtattccactgtttggatatctcacagtttatttatcaatttacctacagaaggacatttccactgcttccaagttttggcaattatgaataatgatgctataaatatccaagtgcaggcttttgtagggccataagtttttaattcatttaggtaaataccaaggagtatgactgtaggctcatagggtaagagtatgtttcattttgtaagaagctgctcaactgccttccaaagtggctgtagtgtttagtgttcccaccaacaatgaatgagactccctgttgctccacctccacatcagcatttgatgctatcagtgttttggcttttagccattctaacaggtgtgcagtggtatctcactgttgttttaatttgcattttcctaatgatatatgatgttgaacatcttcatatgcttatttgacaactgtatatcttcagtgagatgtctgttcaggttgtttgcccattttttaatcaggttatttgttttcttattatcaaggtttaagagttatttgtatattttgaataaaagtccttgatcacatataacttctgcaaatattttctcctaggtttgtcttttcattctcttgacactgtctttagcaagacagaagtttctaattttaaggaagtccagcttaccaattttttctttcatgtattgtccctctggtgttgtatctaaaaaatccatcaccaaacctagggtcattaagatttccttctgtgtaatttatgaagagctgtataattttatgttttacacttaggtctatgatctattttaaagtgcatttttgggaagagtttgcgtgttggcctctagctgttccagccccatctgttgaacacactatccttttgcccttgaattgtttttgttccatgtttcagatattagctaactatattgtgtggtctaactagttagaaataaattgtctattatttaatcaagactacactatcctgattaagtaagtgttgaagtcgagtattgttagtcctctaatttggttgatctccttcgctattgtgtcaactattctgaatcttttgcttttccacataaatttcagaatcagtttattcaaatcctcaaaatcacttgctgagatttctgattattacattttttaaataactacaaaatgattgattttattagtttgttggaaactgcctatctggctatagtctacgtttcagctgttataaaatctgcaagtcctcatacaaaaactttcacactatgatgacacctcactgctgacagcctcctctgcagtcctggagctcctgcaggatacacgctgcatgcacaggtagacatgtgcaacccaggagggcagccagggttttcccaggatgtcaaagctcagaaggaaccaaaaattttaaagatttttaaaaatattttaattttttacaatataggttgaaagcaaatagctccttcaagagctagaacaactgaacttcacatctaataacaagaatgttcaattaaaacagaaagctaccctatggcccttccattcataatgcccatccatgagcctcagcatggactacaagtggatttaggggtccctttcaagatcttcaattgttcagagggcactccactgccctagcggaaggaataaatctgtcacaccacccacaacacagctagttctggagggccaggaccatggcccagaagcagtactgcatgaagattaaacttctcttccttttaagtgtcagatcccaaactgtcaacagtgtatacatgcattgtaacaaacacaaacactaccaacagaaaataatcattcacatgccataggtacatgcatgtgtacacacacacacgcacagactctcacacacatacttcatatttgcttgtcttttactgagaaaaaagggattataatatgcaaaaaacagattttttaaagtaatcatgataacagaaacactcagctaagatgctattctattcatttataaacaccttgcttcctaagggcctgccacaccttaacccatagaactcacttgtggaataaattctttactgaatgaaataagaacttaagtcacaaagtatctattgactatgatatggaaaaaagccttttaaaagcacgtattatcatatataaatacagaatatgaactaagggctacagcaggaaaacgttaactggttatgaattagaatttttatttgtctattgcttgcagggttttattgggcacctagcctgtttgaagcatgaaagctttaaccccaagactcaccctgcaagccaaaagcatactttgttggcaacattaaagcatttctggcttctggcctgggacatcagcaaaaaggcagagtaggcagctccaagggtccatcctccacaaaaccattgaaaattcaagcaaaaactgtcagaatcaactttgtcagaataatggaaacagtaaatggttcgcagcaaccaagcaaaaatggaatggagagaaaggtaaaataaaagcaggaggaaggccctgtggtgttttcatctacccaaatccaccctcctctccagctccacagtgcaggacctggcccctgtcttgaagacagcagcagcattcccagtgcaggacctggcccctggttcccgagggtgcagagcagacttgattcacaaagaattgtgtttgctctaacctgtctggaggctgctgaaggactgattcaaggggctcctctctgttctgtgtaactcagaatgcactcagggcagaaaagtggcaggcactcctggaaaacactagaaggcaaatgagcaacctgcagtccctgggacagaagattaccattgaggcacacggtagagtgccaaaaccatgaaaggaaaggctggggacagggtttaagaaattcaggcattcaacacaaggaactcaaacatctcaacagcaaagaacaaataatcccattaaaaagtgggcaaaggatctgaatagacatttttcaaaagaagacatacaaatggccaggagatatatgaaagaatgctcgacatccatcaccaatcatcagggaaatgcaaatcaaaaccacaatgatatataccatcccaacccagttgcaatggctattatcaaaaagacagaacgtaataaatgctggtgaggatggaaagggaactcttatacactgttggtgagaatgtaaattagtatagctgctaaggaaaatcgtatggagatttctcaaaaaagtaaaaacagaactaccatatgatccagcaatcccactgctggctgtttatccaaaggaaaggaaatcagtatgttgaagagatatccatactcccatgttcattacagcactattcacaatatctaagataggaaatcaacctcagtgtccatcaatggataaagaaattgataaaatgataaattgatacattgttaaagaaaatgggagacacacacacacaaacacacaatagagtactattcacactttaaaaagaaggaaatcctgccttttttaataacatggataagcctgaaagacatcacaccaagtgaaataagcaagccagagaatgataaataccatgcggtgtacgtatgatatactatttggccataagatagaatgaaaatggaatactatctggccataaaaaaagaaaaaaaagaatgaaatcctgtccgggcacagtggcgcacgcctgtaatcccagcactttgggaggccgaggtgggcagatcacttgaggtcaggagttgaagaccagcctggccaacatggtgaaaccccatctccactaaagacataaaaattagcctggcgtggtggcgtgcgcctgtaatccagctactcaggaggcagaggcaagagaatcgcttggacctgggaggcagaggttgcagtgagccaagattgtacatctgcgctccagcctgggcggcagagcgagactctgcctcaaaacaaacaaacaaacaaaaagaatgaaatcctgtcatttacggcaacacagatcagcctgaaggatattatgttaagcaaagtaagtcaggcactggaagacaaataccacatgatctcaaccatatgtgatggctgaaaaaaaatgagctcatggatatagaaaattagaattgtgggtgcagagtctgggaagggtaccagtgaggggaggatgatgagaggttggttaatggatacaaagttgcagctagataggaagcatgaattctggtgttctatagcactatagggtgaatatggttaactacaatttattatatattctcaaaaagctagaatagaggattttcaatgttcacaacacaaagaaatgaggtgatggatatgctaattatcctgattcgatcattacacattgtatacacatattgaaatatcactctgtatcccataaatatgtacagttattatttgacaactaaaaataaaagggaaaaagaaattcaagcattccaaagcacctatgcatatgggtgggaatgtagacagccatgtgaatgcccagagcagaacgcatgctcagaagaagcctgagaagaccccagtctttcacctctggatgagctccaggttcagtataaacaagaaatgaaggtcaaggcatagctgtaaaaagccaggctaagtgttaaaggaggactccaccacagagccactccatacagataagcggtcagtctcttctctctctgtttttctctgcctctctctccaaccccctcgctctctctatcatgttttggcatctggtgctcaaggaaatctctttgacagcactagctgaacaaacaactaaacagagacttcagagaccacacacggtaaggaattacagatcttgcaaaactctacagtctatagcaagcaacaacaaaccctgaggtgggggaagaatctgatctccagagttacctctgtttaatatgcaaaatgtccaggcgtttgttcgtttgttttgagacagggtctcactctgtcacccagggtggagtgcagtggctcgatctcagctcactgcaacctccacctcctggattcaactaattatcctgcctcagcctccagagcagctgggattacaggcatgcaccaccacacctggctaatttttctatttttagtagagacgggattttgccatgttggccaggctggtctcaaactcctgacctcaagtgatctgcccaccttaacctcctaaactgctacaattacaagtgtgagccaccatgcctggcatgttcagttttcaacaataacttatgaaccatgtaaagaaacaagaaaatatggctcattcacataagaaattaacaaacattgtccctgaagaaacacacacactggacttactaaagactttaaatcaactgccctaaatatgctaaatgacttaaaggaaagaaaggaaaaggagctaaaggaaatcaggataagaatgtatgaacaaataagtgaattgaaataaagatatagaaattataaaagggagtcaaattctaaggtcaaaaagtacaccaactgaatttttttaaaaatcactagagcatctcagtaacagacttgactaggcagaagaaagaacccgcgaacataaagacagggcaatgaaaattatccagtctgagaggaagaacaaaaatgataaaagattaacaggtatgaaatgccatcaagcataccaataccaagtacataacaggaatcccagaaggagaggtgcgagtgaaaggaacacaaagaatatttggagaaataattgccaaaacttaccatacctgataaaagatacaaatctacacacacaagaagttcagtgagtttcaagtgagatgaatacaaagaaatccacactgagacacattataatcaaacagtcaaaaagccaagggcaaagagaaaaatcttgaaatcagcgagagaggagccactgattcacatacaagggatcctcaatcagattaacagctgacttctcatcagagaccaggggaccagaaggcaatgaaatgacattttaaagtgatgggcaggatgggggtgatgcttccaaccaagcattgtatgatacatcctacaaaaatacccttgaaaaatgaaggagaaatttacacccacatattgaatggctccaattgtataaaatatcagaaacaggtaacaatccacagggacataattcagactgatggcttccaggggctaggagaggggaaatagggagaaacaatttaatgagtatgggatttcctctggagacaatgaaaataattttggacttttatagagggagtggttacacaacggtgtgaatgtactaaacgtcaaagaattattcacacaaaaattattactgttaagttaatttcacctcagtaaagaaaaataaaacatgggaaaaactggcttctgacaaactgatcaaagttctgaatcacaggcagtagcagaagcagcatggattaccctgagatctcttccttccttccttacctgcctggccgagagaaatatggagcgagggtactgatttaagataatatgctaactgggtgcttgtagcaatatcaaaaggtaatgtaatatagactaaaccatatggaaccatgaactgccaaggacatgagttacctgccaaagtaagacgttgcccttgggtgcagacagaaaacatggtggggtgatctttatcaacagtcagcaacaggataaaattccatgtgtaaaggccacctgaactttgattctgtatgtgcgtattttacaagaatgtaagagcagtccaaaaactattttaattgaattcattctatacataggtgcatcccaatgccaattactggcatcaattctaaaccaataaataagaacatatgtattttacgcacaaaatgtcatgtctctctggatatcccatgcacaaccccaacagtacccgtccatcagagcctgcagctctatgaaggagaacttaacagcactctaggtgaacacgcccctgcctgatgccgtccacaaagctaggcacatttgcacgtctgggtaccatcgctcagctacacaaccacaggccatgacggcgcagttcttccaactaggctgtgctgacacaggtctcgagatggctgatgcttttgatgcatcctgaagttttgctacaaagatcaccacaaaaatgttcaagcatcaaaatgttttaattcttctgaaatgaaactgtctctaaatagctcagcaataaaattcaataattctattgggttcaaagcagtttaacaatggaaaatgaattatatagtcaaaggtggtccattctcgctctccagtaaacatttctgtatgtgcggaattggtgggttctcggtctcactgacttcaagaatgaagccgtggacccccggtgaattttacacttcttaaaggccggtgcatctggagtcgttagttccttgtggtgttcggacatgttgggagtttcttccttctctcccaatgggtttatggtctctctggcctcagaagcaaagctgcagaacttcgctgtgagtattacagctcttgaaggtaatacagagcctaagagtgagcagtggcaagatttaccgcaaagagcgaaagaacaaaacctccacaacatggaagagaacccaaacagtttgcggctgctggctccggcagcctgcttttattcccttgtctgaccccacccacattctgctgattggcccattttacagagagctgactggtccattttacagagagctgattggtccgttttacagagagctaattggtctgttttgacagggtgctgattggtgcgtttacaatcgctgacctagacacagagtgctgattggtgtatttacaatcctctagctaggtgtaaaagttctccaagtccccactagattagctagacacagagcactgattggtgcatttacaaaccttgagctagacacagagtgctgactggtgcatatacaatcctccagctagacataaaagttctccaagtccccacctgactcaggagcccagctggcttccgctagtggatcccgtgccagggccgaaggggagctgcctgccagtcccactccaggcgcctgctctcctcagcccttgggggtctatgggactggacgcctatggagcagggggtgatgcccctctgggaggctcaggcaggaggctcgggcagcacgggagcccactgcagggggcagcatggcgggctgcagatccccagccctgacccgtggggaggcggctgaggccccgcgagaattcgagtgtggcacaggcgggccagcagtgctaggagacccagcgccccctccacagctggtggcccaggtactaagcccctcactgcccagggccagtggcaccagttggccactccgagtgtggggccgctgcctgcacccacccagatcttgggctagcccacgagccctgtgcacagccctggttcctgcccgcacccctccctccacacctccccgtaagcagagggagctggctcctgcctcggccagcccagagtggggctcctacagtgcagcagggggctgaagggctcctcaagcgtggccaaagcagacatcgaggcccaggaggtgcagagagtgagcgagcgagcactgctagcacattgtcacctctcatctagacttgttgagtgtgagtacctgccctttctggaacaaaccatcaattcttttgctccctacaattttaagttccaatctggtgagccctagggtccctaggtttcatattgtagaaggctttaaatctaaagagtccttggataaatggaagggcaaagtaaatctcaggaagtttcacacagtagctatctgactgcattcaagaaagaaatctctgtattttccttcaacttctctcacacagcccaaagttgttgggagaaggtaaaggaaaaaacatgaagatttatttcatggagatagccagcataggggaaattatttaccttttcgacttagaacaactagaaaacaagtttccaatcatggtcatctcctgcctcacagtagacattaaagttaagttagagaattcacaaccacacccttctgattgacactatacatatcaatctcgttactcaactgaggggaaaaaactatttccatcagctagaccttttcctgcactccatgaaaagctcaaacactcaggatgtcaaacttaacttttttgcaatcacacagcaaggcccaatctgtcaaagccatacgattcactgcctttatttctactgttggtttgatttttttttttttctagcttgtgggtttcagggcagacaaaggcagctaaaagtctcagggagaaaaagaatctccagtaggctgtaccatagacatccccatttattgcatgtaacttacttcacttctcaaccccacagtttaatcacctgtataaaactggcgcagtaatactcagactgcaaagtcattgtaagaattagcagtagcatgaggaaaacatcagctcatgttaggaatgcactgattattacctggcattatttagattgattaataagttcatatatgcatagtgggaaacaccttggtctaacattctttggttctaattatgattacgatatcatgtgatttccatgtgttagagagcaagtcataattatcaccattgtaaaaggagaagtacattctacatcagattgacaaattgtgttctataaaactctaagaagccaggcagatacctcaagagccatgaggactcaataggaaggttgctaaattctatgagctatcggttatgaccttcaagtgttaaacatattaatatagaggtataacttttcccgataggaaataaaaggcaattactattttaacatgctgccaaacacactgcctattgttaaaataattgttaaaatttttattgaggctgggcacggtggctcatgcctgtaatcccagcactttgggaggccaaagcaggtagatcacctgaggtcaggagttcgagaccagcctggccaacatggtgaaaccccgtctctactaaaaatacaaaaattagccaggcgtggtggcgggcacctgtaatcccagctattcaggaggttgaggcaggagaatcgcttgaaccctggaagcggaggttgcagtgagctgagatcacgccactgcactccagctggggcgacagagtgagactccgtctccaaaaaaaaaaagtttttgttgaaataaattattttaaataacagtgacttcagttaaaatcctaattagtgaacttattagtaattcaataatagtatttccaatgcttccctgacaacccttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgacaactctttttacctcataaagagaagctatgtaaatcctgaggcaaacagcacgcttaatgctgagcatttaaaagcattctcaggcagaaggatcacttgagcccagtaattcaaggctgcagtgagctatgataacaccactgcactccagccagtgtgcagagtaagatcctgtctctaaaaataaataaatagttcagatagaaataaacagaatatagatagatagacagatagagataataaaagcattcctggctaggcatggtggctcaggcctgtaatcccagcactttcggaggctgaggtgggcgaatcacctgaggtcaggagttccaagaccagcctggccaatatggtgaaacctcatctctactaaaaatacaaaaaattagccagggtggtggctcacacccgtaatcccaggtactcgggaggctgaggcaggagagttgcttgaacccaggaggcagaggttgcagagagccaagatcacaccactgtactccagcctggccaatagagtgagactccatctcaaaaaatttaaagaaagcattcccaatgaagacacagcaaaaatgctctccttcactattactattcaatatttaatgggaattcccagccagcacaattaagaaaataagtaacaaggatcgaaaagagacaatattatcattctttactgacagaatgattacatataaaattcaaaaacatatacaaagtatcagacctaatacgagtttggaaagactataggaaaaaaaaaaactttaaaaacgctttccaatatttcaataacaatcaattaaaaaccatttttagaattagcaataaactccaccaggtacctagaaaaaaactaagacacaagaactttatacacataaaattgtgccaaaatacgttaaaatgtattcaactcttccagctttattgtggtataagtgacaaataaaaattgtatatattttaggtgaacaacataagttgatacacatattcactgtaaaatgattaccacaatcaggccaattaacatatccatcacctcacatagttaccatttttatccttgtggtaagaatatttaaaatctactctcttagcaaatttcaagtatacaaaacattattattttagttatagccacattaggtctccaaaactaactcatcgtgtaactgaaagtttgttcgctttgaccaacacctacccatttcccacaggcccagcccctgcaaccatcattctcctctctgtttctatgagccacgtttttagattccacatataagtgagaccatgtggtatttatcattccctggcttgcttatttcacttagtgtaatgtcctccaggcttatccatgttgttcaaaaaggcaggatttcctttctttgaaggctggctaatactcctctgcctgtgtgtttgtgtgcatgtgtgtgtgtgtctggatgtgtgtttgtatgtgtgtcacattttatcagtttatccactgatggacattaggttgttcccattatcttggctattgtgactaatgctgcagtgtacatgggggtgtagatttatctttaaaacactgatttcaattactttggatatatacccagaagtagaattgttggatcatatggttgttctataattttttgaggaacctctatactgtttaccacaatggcagtaccaatttacattcccagcatcaatatataagggttcccttttctccacaacctcaccaactcttgttatctgttggtactttgagaatagccattctaacaggtgggagatcacatctcattgtagttttgatttgtatttccctgatgattgatgatgttgagcactttttcacatacttgttgccatttgtatgtcttctgtgagttgcctttacatttcattgtttcctttgctctaaagaaatattttagtatggtgtagtccaattatttgtttttacttttgttgcttctgtttttggtgtaatattcaaaacatcactgctaagatccatcttattgagctttctatgttttcttctaggagttttgtggcttcaggcctttcctttaaatctttaaacaattttaacttgatttttgtgtacagtgtcagataactctccaattttgtttcctttcatattttttctttttttgcatgaggatatccagttttcctaacaccattaattgaaaacaatgatccttttcccattgtgtattcatggcacctttgtcaaagattagttgaccatatatgcatgggtttatttatgggctttctattctgttccattggtctatgtgtctgtttttatgccagtagcatgtttttttggctactatagctttgtaatataatttaaaatcaggagatgtgatgacttcagttttgttcttcctgttaaaaattgcttgggctattcggggtcttttgtggttccctatgaattttaggattgttttttctatttctgtgaaaaatgccaatgaaattttgatagactgcattgaatctgtagatcactttgggtattatgaatatttttataatattgattattctgatccatgaacatgggatatcttcccatttgtgtatcattccatttcttttatcaatgtttcatagtttttggtgtatagatcttgcatctccttatttaagcttatttatgttattatttttgatgctattgtaaatcagactgatttcttaatttctttttctaatactgtacactaatgtgttattagtgtacagaaacacaactgctttttatatcctgcaactttactaaattcatttatagttctaattagttttggggtggtgtctttaggaatttctattacaagatcacatctcctgcaatcagaaacaatttcctccttcccaatttggatgactaataaaataaataaataaaataaaataaaataataaaattatttttactgcctaattgctttgactaggatttccactactactttaaataaaagtggtgagagtgggcatccttgtcttcttcctgattttagagaaaaagctctcaaccatttatggttgactatgatggtagcttgtgaaatatgacctttattgtgttgaggcatattatttctatacctaaatttgtttagagtttttgtcataaaagattgttgaattttgtcaaatgttggtttaaatatttgagataatcatataatttttgtccttcattctttctgttaatgtgttgtaccacacttattgattatattgaactatctttgtatcccagggataaatcccacttatttgtttaatatgctattgaattcagttttctagtattgtgctaaagatttctacacatatattcatcagggatattggcttgtaattttctttccttgtagaatttttgcctggctttgctatcagggtaatgctagcctcataaaacaagttggaagatgttccttcttgctatggtttgaatatgccctccaaagttaatgtgttagaaacttaatccccaatgcaacagtattaggaagtagggcctaatgggaggtgcttaggtcatgagggttccatccttatcaatgcattaatgctgattataaaagggcttgaagctgtgagttccatctcttgctctctcgcactctttttctcttctgccttctgctatgcaatgacatagcaagaggatcctcaccagatgtgggccctagatcttggacttccccgtctccaaaactgtaagaaattaatttattttctatgtaagttaccaagtctgtggtattttgttacagcaacacaaaatagactaagacattttctcttcaattttttttggaagcgtttgagaagcactggtattaattcttctttaaatgcttggtagaattcatcagtgaagccatcggatcctggacttttctttgatagaaagatttttgttactgattcaaacttcttactcattattagcctgttaagacttctttttcttcacgattaaatccaagacttctttttcttcatgattaagtctttgtaggttgtgtgtttctaggaatttatccattacttctgggctaatttattggcatataagtgtttgtagtactctcttaggatcctttgtaatcctgtggtatcaattgtaatgtcttccctttcatttctgattttattttagtcttcttttttcttaatctaattaacagtatgtcaatttcatttatcttttcaaaaaaccaactcttagttttgctgatcttttctattatttttctaagttctatttcatgtatttgttctctgatctttactatatccttccttctgctaactttagtttgttcttctttttctagtttctcaatatgtaatgataggttgtttatttgagatctttcatttttcttcatgtaggcatttttcactataaactttcctcttaaaactacttttgctgcatcacctatgataagatttggctctgtgtccccatgcaaatcttatctcaaattgtaatccccatgtgttgagggagggaactggtgggaagtgactggatcacagaggtggtttgccccatgcttttctcgtgttagtgactgagttctcatgacagctgatggcttttaagtgtggcacttcctcactctctcctgctgccttatgaagatgtgccttgtttccccttcaccttctgctatgatcgttaagtttcttgaggcctccccagccatgtggaactgtgagtcaattaaacctcttttctttataaattatccagtctcagtatctttataacagtgtgagaatggactgatatacccaaagttttggtacactgtgttttcattttcatttgtctcaagatattttttaattttcctactgatttcttctgctccattggttgggagtatgttgtttgatttccacatatttgtaattttcccaattcccttccattagttatttctagtttcatgatactatgatcagaaagaaatattacataatttgatatataattaaaatataatttcaatctgcttaaatacattaagacttgttttgtggcccaacgtataacctatcctgaagaatgttccatgtatactttagaagaatctgtactctgctgctgttgaatagaatgttctgtatttctgtatatatctgttaggtctacttggtataaagtgtaaaatctaatgtttccttactgattttctctctggatatcctgtctgtagttgaaagttaggtaatgaggtccctcattattactgtattgctgtctatttctcctttcagatctattaatatttgctgtatattatttacgtggtctgatgttgggtacatatatgattattgtgtcctcttaatgaattgatccctttttcattacataatgacctttttgatctcttttaaagttttgtagtcaaactatattttgtctgatataaatatagctacccctgctctcttttggtttccatttgcaagaagtatcttaattccttcacattcggtttatgtatgtctttaaagttgaagtgattttcttacggcagcatatagttgagtcttgtttttaaatctattcagccaatctgtcttttgactggataatttaatgcatttacattcaaggtaattattgataagaactttcaattgtcattttgttaatttgtttctgggtgttttgaggatgccttgatcctttcttcctctcttgctgtcttcctttgtgacttgacaattttctgtagcagtatgctttgattcctttctcttcatcttttctgtatctactatatgtttttgctttgccattaccatgaggcttacataaagcatattatagttataacagtttaagctgataaaaacttgtttgtttgttttgagacagaggcttgctctgttgcccaggctggagtgcagtggcgtgatcataactcactgcagcttctaactccttgagagatgatcctctcacccaagcctcctgggtacctaggactacaggtgcacacactaggctaattttttttttttttttagaaatgaggtctcactatgttgcccaggctgatgtcaaacacctaggctcaagcaatcctcttgctttgtcctctcaaagtgctgagattacaagtgtgagccaccatgcccagtcaaaaacttaactttgataacatacaaaaactctacactactttctgatagtgaagtgtaagtaaattcttcctaattggtaattacatattgtgtaaatgaactaaactctctaagagaaaggcagagattggcagaataaattagaaacttgtggaactgtatgctgtctacaagagactcactttagattaaaagacaaaaacaggttgaaagtaaaaggaaagaaaaggatatttcatgtgaacagaaaccaaaatagagctggagtgtatacactaatatcagatgaaatacactttaagataaaaattgctactaaaaacaaagcagcacaatatacactaataaaaaggtcaagtcattaagaaaatactgcaattataaatataccacacctaccaacagagtcctaaaaatacctgaagcaaaaaattgacagaattgaaatacaaaatagggaattcaacaataatagttggagaattaaatacctcaatttcaataatgaatagaacaaatagaataacagcaaggaaacagaagacttgaacaacactataaaccaatcaacttgacatctatagaacactcaacccaacagcagcagaatacacattcttctcaagcatacatggaacattttcctgatgaaacatatattgggccaaaaaacaagtctctgtaaatctttaaagattcaaataatgcaaaacatgttctctgatcacaaaagaataaattaagaaatcaatcacaaaaggaaaactggaaattcacaaatacatgcaaattaacaacacattccattggccaatgggtcaaagaagaatttacaagagaacttagaaaatactttgagataaaataaaaataaaatacaatatactaaagcttaatctttcatatcagagtttaatccatttgaataaaagcagtgctcagagggaaatttatatctgtaaatgccttcactaataaaataaaaaactctcaaatcaataatctaaccttccaccataagaaacttaaaaaagagcaaattaaatctaaatcaaacacatacaaaaaagagattggagccaaacagagaacagaaaaacaacatagaaaatcaacaaaaccaaagttggttctttgaaaagatcaacaatattgacaaactttagctaggctgagcaaagaaaaaatagaagactccaattactaaaatcaggaatgaaagagagaatatcataattctaagaaaattctatgaaagctggataccatcaaattagataccctagatgaaatggacaaattcttagaaacacacgatctaccaaaattgactcaagaagaaacagacctgtagctaataaagaaatgagtcaacttttctaaaaaaaaatctttcaatgaggaaagcctcgaccagatggtttcattggggtattctacaaaatgtttaaagaaaaattaacaacattatttctcaaactcttacaaagagtagaagagaagggaatacttcgtaattcattctgtggaagtgaaacacatcaaaagtaaaaactacagatcaataaccgttgtgactacagatgcaaacattctcaacaaaacattagcaaatggaatctaacagcatatgaaaggggttattcaccatgaccaagtagagtttatcccagaaatgtgaggttggtccaacatataaaaatttatcaacataataaagcatattagcataaacccacatgatcatctcaatagatgcagaaaaagtatttgacaaattccaacatcttttcatgataaaaattctcaacaaattagaaacagaaaagaaaatttcttaacctgataaagggcatccatgaaaaaccaatagctaacatcatacttaacagggaaagactgaaagctttgctcctaagatcaggaagaagacaaggatgtctacctctcaccacttctattcaacattttactggaggttatagccagggcaaaaaagaatgctgtaggcaagaagatgaaataaaatgcatccatactgaaaaggaagaagtaaaagtatctctgttcacagatgacctaattttatatagagaaaaccctaaataataaacacacatacatattaaagctaataaatttggcaaggtgacacgatataagttcaatgtataaaaatcagttgtatttgtatacacacaatgaaaaattttaaaatgaaatgaaaaagacaattccatcaacaataccagtaaaaagaataaaatattcagaaaaaatctaactaaagaagtgcaagacatatacactgaaaaccataaaacattgctgaagtaaattaaagactgaaataaatgaaaatatatctaatgttaatggacagatcaaagcaattcctatcaaaaatctcatcgagaatttttttttgcaaggatcaacaaactaatcctacaattcatatggaaattcctgaaacccagacaagtcaaaacaatcttgaaaaagaacaaagtgagaggaatcacactttctgatttccaaatttactacaatgctacagtaatcaagacagtgtgatactggtataagacagtcaaatagatcagtgaaacagatctatggccaagtaactttcaacaagagtgccaagaccattcaataaggaaagaataattttctcaagaaatggttctaaaactagatatccacatacaaaggaatgaagttggaccccaccttataccatatacaaaaattaatgcaaaatgaatcaaaggcctaaatgtaagggctataactaaaaatcctagaaaaaaaaagcatagatataaatctgtgcaactttgagttaaggaaaagttttttggaaaggacactgaaagcatgtgtgaccaaagaaaaaatagatgaattgaacctcatcgatatttaaaacttttatgtttcaatcagccctatccacaaaatgaaaagacaacccatagaatgagggaagacatttacaaatcatatgtctgataaaggtctagtaaccagcatatataaaggactcctagcattcaacgacaagaagtcaaataactcaactaggaaaagggctaaggatttgaacaaaaatttctcgtaagaagatatacaaatggccaataaatgcatgaaaagatctttagggaagttcaatatcattggccattagaaaaatacagatcaaaaccacaatgacataccaatttcatacccactaggatggctagaataaagggggaaaaaaaaaccagaaaataagtgttggcaagaatatgaagaaactggaactcatacgttgctgataggaatgtaaaatgttgcagctgctttggaaaacagtctggtagttaaacactgaattaccgtgtgactctgtaattctacccttacatatatacctaacagtattgaaaagatatgttcacacaaaatccagtacactaaatgttcacagcggcaatcataatagtctaaaagtggaaagaaaccaaatgttcatcaattgataaatggttaaacaaaatgtggtatatacatatggaatgtcattttccacaaaaaggaagtgctattgcatgctataacatggatgaaccttgtaaacattatgctaagtaaaagaagccaaatacaaaaggccacatattgtatgattccagttatgtgaaatgtccagaagaggcaaaatcatagaaacagatagtagatttgaggtgccaagggttagaggattggggaattggaggtgactgctaacagttatgagatttctttttggggtgatggaaatgttccggaattacgtcatgatgatttaacataacactgtgactatactaaaaaaacactaacctgtacacttcaaaatggtgacttgcatgttatgtgaataatacctcaataattaaaagaagtaaggataataaaatcatcttaatcagccagctatgctagagcaagtaaagctaaatatctttttaggatctagagaaaataaaattataaaattatcatactaatagacaattaatgaatatgcagcaaaaaactattacaaagatgggtcatgcaattctttaacttgtaaatgttatttttctcaactgtgtggtatatttcatgcatttaaagcatttttaagtttataattcattgtgatttgttttttcattccaaataaatatccactgtcatgactaaatttgtatttacaattttgtattctttctgttaaaagaactgagatgggccctacaaaacttgaatcctccactggagataccttttcacaaccatcacagtagctaaaattaaaaagtctaataatacttggtattggagagaaagtagacgaatgttaactctccttggccctactaggagtacagattgatttaaacaatttgaagagcagtttgacgattatagtgacattaaggtgccccaggaattctacttctagagacaggctctaccaacatgtttctacctatgcacccctgcagcatgttgtaaaggcagaacaccagaaacaggctaaacggtcagcaacaacacaacacagaagattgggatatgttctcagaagggcactctatagaggagttaaatgactttatgcagatcaacccacatggaagtggaaaacaataccaactgtgaaaagcaagtttcagaatgacatcacagttaaaaccatttgtgtgatgttttgaaacatgcacacaagtactacatattgattccagaaacaaagaaatgaagtaaaagagaaattcctctttgtttacagaggaaatagacaggttggaaaaggacacgagagactgtaacttgatctgtgatattttgagacaccatgaagaagaactgaagcgtgtgtttccaagtttaggcatccatgaattctgcctcgtgcttttatacttaggattcttaggctcactctctgaccttttctatttgaagctggattcagactatttacctgagtggaggaaatacttgaatcttaaagatcaaactcaccaacaaagaagtggggaaagcagtcatgagtaattcatgaaatgctaagtaaaataataatgcattcataacatttttcatctatcaaactagaagctctggtgtcttccatgatgatacccagggctggcactgtcatgttaggtcattagaaagccttgaaaacatatttatccctttgcagaagcaggtctgttctcataaggagattcttctgaagttgtgcaaagattttgatacaaggatgtacaatgccaagtcaccttgtagatgacaagagaaaaaggagaaaaaatgtccaacaactgtttgttaaattggaatatcttatacaaaccataaacatagagtggatacttataaagacaataaaaaaggcatggagaatgtttaagtgtttagaaaacatgctccccctgggcagagcccaccccagtgccacaaagccactgtagccagactgcctctctaggttcctcgtctgtgggcaaggcatctcggaaagaaaaacagcagcacccgtcaggggcttatggataaaactcccatctcccttggacagagcacctgggggatgggacagctatgggcgcagcttcagcagacttaaatattcctgcctgctggctctgaagacagcagtggatctctcagcacagtgctcgagctctgctaagggacagattgcctcctctagtgggtccctgaccccagtgcctcctgatggggagacacctcccagcaggggttgacagacacctcacacaggagagctctggctggcatctggcaggtgcccctctgagatgaagcttccagaggaaggagcaggcagcaatctttgctgttcagcagcctccgctggtgatacccaggcaaacagggtctggagtggacctccagcaaactccagaagacctgaagatgaggggcctgatgaccgttagaaggaaaactaacaaacagaaagcaatagcatcgacatcaacaaaaaggatgaccaagcaaaaacaccatccgagggtcaccaacagcaaagaccaaaggtagataaatccatgaagatgcagaaaaaccagagaaaaaaggctgaaaattccaaaaaccagaatgccccttctcctccaaaggatcacaactccttgccaacaagaaaacaaaactggacagagaatgagtttgatgaactgacggaagtaggcttcagaaaatgggtaataacaaactcctcctagctaaggaagcatgttctcatccaatgcaaggacgctaagagccttgaaaaaggttagaggaattgctaaccagaatagccagcttagagaagaacataaatgacctgatggagctgaaaaacacaacacgagaacttcgtgaagcatacacaagtatcagtagcccaatctatcaagcaaaagaaaggataccagagattgaagattaacttaatgaaataaagtgtgaagacaagattagagaaaaaagaatgaaaaggagcaaagcctccaagaaatatgggactatgtgaaaagaccaaacctacgattgattggtgtacctaaaagtgatggggagaatggaaccaagttggaaaacacacttcaggatatcatccaggagaatttcaccaacctagcaagacaagccaacattcaaattcaggaactagagagaacatcacaaagatactcctcgagaagagcaaccccaagacacataatcatcagattcaccaagattgaaatgaaggaaaaaatgttaagggcagccagagagaaaggtcgagttacccacaaagggaagcccatcagactaacagcagatctctctgcagaaaccctacaagccagaagagagtaggggccaatattcaatgttcttaaagaacagaattttcaacccagaatttcatatccagccaaactaagcttcataagtgaagttcaatagaatcctttacagacaagcaaatgctgagggattttgtcaccaccaggcctgccttacaagacctcctgaaggaagcactaaatatggaaaggaaaaaccagtacagccactgcaaaaacaaaccaaaatgtaaagactatcaacactatgaagaaactgcatcaacaatgggcaaaataaccagctaggatcttaatgacaggatcaaattcccacataataatattaaccttaaatgtaaatgggctgaatgcccccaattaaaaggcaaacactggcaaactggataaagagtcaagacccatccatgtgctgtatttaggagacccatctcacatgcaaagacacactaggctcaaaataaagggacggaggaagatttaccaagcaaatggaaagcaaaaaaaaagcaggggttgcaatcctagtctctgataaaacagactttaaaccaacaaaaatcaaaaaagacaaacaagaggattacataatggtaaaagaatcaatgcaacaagaagagctaactatcctaaatatagatgcacacaatacaggagcacccagattcataaagcaagttcttagagacctagaaagaggcttagattcccatgcagtaatagtgggagaatttaacaccccactgttgatattagacagatcaatgagacagaaaattaacaaggatattcaggacttgaactcagctctgcaccaagcagacctaatagacatctacagaactctccaccccaaatcaacagagtatacattcttcccaggactacatagcacttattctaaaattgaccacataattggaagtaaaacactcctcagcaaatgccaaagaacagaaatcataacggtcactcagaccacagtgcaatccaattagaacttaggattaagaaactcactcaaaactgcacaactacatggaaactgaacaacctgctactgaatgaccactgggtaaataacgaaattaaggcagaaataaataaattatttgaaaccaatgagaacaaagacacaacgtaccagaatctctgggacagctaaagtagtgtttagagggaaatttatagcactaaaatgcccacaggagaaagtgggaaagatctaaaatcaacaccctaacatcacaatgaaaagaactagagaagcaagagcaaataaattcaaaagctagcagaagacaagaaataactaagaccaaagcagaactgaaggagatagagacatgaaaaacccttcaaaaaatcagtgaatccaggagcagattttttgaaaagattaataaaataggccgctagccagactaataaagaggaaaagagagaaaactcaaatagacacaataaaaaatgataaaggggagattaccactgaccccacagaaacaaaaactacaatcacagaatactataaacacctctatgcgaataagctagaaaatctagaggaaatggataaattcctggacacatacaccctcccaagactaaaccaggaagaagtcaaatccctgaatagaccaataacaagttctgaaattgaagcagtaattaatagcctaccaaccaaaaaaagcccaggaccagatggatttacagccgaattctaccagaggcacaaagaggagctggtactgttccttctgaaactattccaaacaacagaaaaagagggactcctccctaactcattttatgaggccagcatcatcctgataccaaaacctggcagagacacaacaagaaaagaaaatttcaggccaacatccctgatgaacaccaatgcgaaaatcctcagtaaaatactggcaaaccaaaccagcagcacattaaaaagcttatccaccacaatcaagtcggcttcatccctgggatgcaaggctggttcaatatacacaaatcaataaatgtaatgtatcacaaataaacagaagcaatgacaaaaacgacatgattatctcaatagatgcagaaaaaggtcttcgataaaattcaacaccccttcatgctaaaaactgtcaataaactaggtattgatggaacatatctcaagataataagagctatttatgacaaacccacagccaatatcatactgactgggcaaaagccggaagcattccctttgaaaccagcacaagataaggatgccctctctcaccactcctattcaacagagtactggaagtcctggccagggcaatgaggcaagagaaagaaataaagggtattcaagtaggaaaagaggaagtcaaattatctctctttgcaggtgacatgattgtatatttagaaaacctcatcatctcagcccaaaaactccttaagctgataagtaacttcagcaaagtctcaggatacaaaatcaatatgcaaaaattacatgcattcctatacaccaataatagacaaacagagagccaaatcatgagcaaactcccattcacaattgctacaaagagaataaaatacctaggaatacaacttacaagggatgtgaaggacctcttcaaggagaactacaaaccactgctcaaggaaataagagaggacacaaacaaatagaaaaacattccacattcatggacagggagaatcaatatcatgaaaatggccattttgcccaaagtaatttatagattcaatgctattcccatcaagctaccattgactttcttcacaaaattagaaaaaaattactttaaatttcatatggaaccaaaaaagagcctgtatagccaagactatcccaggcaaaaagaacaaagctggagggcatcacgctacctgacttcaaactatactacaagactacagtaaccaaaacagcatggtactggtaccaaaacagacatacaggccaatggaacagaacagaggcctcagaaatgacaccacacaactacaaccaaatgatctttgacaaacctgacaaaaataagcaatggggaaaggattccatatttagtaaatggtgttgggaaaactggctagcatatgcagaaaactgaaactggaccccttccttacatcttatacaaaaatcaactcaagacggattaaagattttaacgtaagacctaaaaccataaaaaccctagaataaaacctaggcaataccattcagaacacaggcatgagcaaagacttcatgactaaaacaccaaaagcaatggcaacaaaagccaaaattgacaaatggaatctaattaaactaaagagcttctgcacagcaaaagaaactatgatcagagtgaacaggcaacctacaaaatggaggaaaatttttgcaatctattcatctgacaaaggggtaatatccagaatctacaaggaacttaaatttacaacaaaaaacaaacaactccatcaaaaagtgggtgaaggatatgaacagatacttttcaaaagaagacatttatgtagccagcaaacacatgaaaacaaactcattatcactggtcattagagaaatgcaaataagaaccacgatgagatgccatctcatgccagttagaatggcgatcattaaaaagtcaggaaacaaaagatgctggagaggatgtggagcaacaggaacgcttttacaccattggtgggagtataaattagttcctccattgtggaagacagtgtggcgactgctcaaggatctagaactagaaatactatttgaactagcaatcccattactgggtatatacccaaaggattataaatcattctactataaagacacatgcacatgtatgtttattgcagcactattcacaatagcaaagacttggaaccaacccaaatgcccatcaatgttagactggataaaaatgtggcacatatacacctgtaatccagtactttgggaggccgaggcgggcggatcacgaggtcaggagatcgagaccatcctggctaacacgatgaaaccccatctctactaaagataccaaaaaaattagccgggcatggtggctggcacctgtagtcccagctactcaggaggctgaggcaggagaatggcgtgaacccgggaagtggagcttgcagtgagctgagatcatgccgccactacactccagcctcggcgacagagtgagactccatctcaaaaaaaaaaaaaaatgtggcacatatacaccatggaatactatgcagccataaaaaagaatgagttcatgtcctttgcagggacatggatgaagctggaaaccatcgttatcaacaaactaacatgggaagagaaaaccaaacaccacatattctcactcataagtgggaggtgaacaatgagaacatatgggcacagggaggggaatatcacacactggggcctgtcggtgcggtggggggcaaggggagggatagcattaggagaaacaactaatgtagatgacgggttgatgggtgcagcaaaccaccatggcacatatatacctatgtaacaaacctgcaggtctgcacatgtatcccagaacttagagtataattttaaaataaaagaaagaaagaaaaagaagacatgctcccatgtgttaagcgggtttcctgcagaggagggctcatttttacataagattcccaaagcagcctccttatatccagagtgtcagagattttacttttcttcttcttttttcttttcttttttttttttttgagatagagtcttgctctgttgcccagtggcgtgatcttagctcactgcaacctccacctcctgagttcaagtgattcttcctcctcagcctcccaagtaactgggattacaggcgtgtgccaccatgtccagctgatttttttttttattttttgtagttttagtagagttggagaggctggtctcccaactcctggcctcaagtgatctgcctgccttggcctcccaaagtgctgggattacaggcgtgagccaccacacccgactgagagtgtcagagatttgtcaaagggcctgcaagtatcctggcctgaaacctcacaggctgcttctgaatgataaaaactgacctgtcacttctgcaccattggtttctggtcttccatcacttccagcctcgaagggtgctcccacagcttagtacctgcataacaaaccccttaccccagcatatctaggatgccaacaactgtaaggcacaccacaagagaaaatgtatgctgccaataaatgctgacgtgttatctattgtaaagaagcatgcaggccctggcagtgttgaaatgtgaaaatatgcacatccagcaatcaaaacacctcatgcatactacaatattaacagagattgttttagaattatgaaatcagggccggtgctttggctcatctgtattttctaaactttctatggtgaacgatattactgccaatatttgaaaaatggtaaataaacattattttaaacaaaaaaaatgaaatgagccaaccagaactaccatgaacctaatgaaactaaagctttgtggccttccaaaggcccctggaagaagccctagtttgtttatatttgtattttttgttatttgtcataaaacaacccctcaaactacacatgcttcaggccccataaagctatgagctgtcttggattcaacaaatatggagtacctaacaagtccacgtggactgctttaaaagacagacagaaatagaaacatttcagcttaagtgaggatacaagcaagcccagataaccacaccaaggcaacaagaccaataatccctctccctttcctaattatcactcctgctgctatggactgaactgcgtcctcccaaaattcgtatgttgaggcactaaccccaatgggatggtattaggagatggggaggtgatcagggatagatgaaaccatgagtgtggaggccccatgttgggattagtgaccttataagaacaggaagaaacaccagagctttctgtctccaccatgcaaggacacagcaagaaggtggccatctgcaaaccaggatatgagccctcaccaggaactgaatctgcaagcactttgacctgggacttctcagcctccagaactgtgagaaataaatgtctactgtttaagccacccagtttatggtatcccattagagagcagcccgagctgactaaaacacctccatactccatctctagtgattataactggtgatgcacaaatccactggtaaactgtcagatattgaagccaccaccacgctctatagtttggttctgttgaagttttataagtaaataatgaactgccaatgttgtataaatgctatggggaatattcacccaaggattctttcttttctctgaaatctctcatattctttaaaaagtcagcctcttttcatctgcagtgagattttctctctaaatccttctttaaacactctttttgtgtgacgtcttagccttaagtactgagccttaaagaaaagctgttttccactcactgccttgttttacatatgctctccctgagctttcaaaatggcaaaataaagcatcttagggaccacaagggccgcctgctttgaactacccagcagtaaaggggccaagtgacaaagctagtcggtacacccggcccaaagcaccctaaagccaaacacaacacaacactttgtcaaattaattattaggctgcatcaaaatatgaagccactaaaagtggatgtactctatttgaaaaggaattttaaaaccctaaggttccacggaacctagtttgaaaaccattggtcaacattagcaagaagcaaacaaaatgaggaatttttccctctgcaaaaccatgtcccctccaccttctccgtggagggaagacacagtgttgatacacatacctgccatgatacaggggagagtgcatgacacacatttaaaaaggcgtggggtgaacaggcaattctcattttagcaagactgttagaacttcattcagccaatgatgaacatgtgctccactttgaaaacaaaaggcagccttgtctcacccatgactctctgtccctattccacaaggagcattcccacccaaatgcaagctctcagcttcatggacacgctaaggaggctctcaccaggagcacctccgagtccatgtccacatctctgcagtatggccccagccagatctggagcacattcttgtattcaacacatttataaagtgcctcatcaatacctggcgctgttcttgaccatccgtgaacaaaagaaacaacaatctcacccttgcagtgtctacattctagaggggagagacctcctaagtaattaaattgggcacaaaagaatgatgagtgctccgggggaaaaacagagcccagatagggggagcagggagtgctggggcaagtgttttgcttctgtttcggtttttatgtggtaaaaaacatgtaagatttaccatcttagccatttttaagtgtacagtactatagtgttaactacatgtaccctgtttgacaacagatctctagaacttcttcaccttgcaaaactgaaactctatatccaatgaacaactctcctttccccctccctccagcccccggcaaccaccattctgctttctgtctctaggtgcctcgtatgagtggaatcattcagcatttgtctttctgtggctggcttatttcacttagcataatgtcctcaaagttcatccatgttgtagcctgtgtcagaatttccttccttttgaagactgagcaatcttccactgtgtatacagaccacattttatgtatccactcatctactgatggacacttgggtagctcccaccttttggctattgtaaacaaggcttccatgaacataggtgtgcaaacatctgttcgattccctgctttcagtgaagacctagttttaaacagagctgtcagtgtggttccatgcctttcctttcctctgcagccctctgtccaccttctctgtaggggggaaattcccactttagtctatttcctggcactatttcatcagtagctatgcaacccacacctgcattttcagaacaactcccacaaactgcagaggactcaatatcacctattttctaaagatggatttcttcaaagcacagggctgttgggaccagagtgcaataaaagagtgaggaatggagaatgaaaacatgaatcatgaacgtgagcagctggctctgttttcagaggcacttgtcagttcccccaaaagacagcccctcatcatgtccttcaacacggcaggatagacaggacaatgtcacccatgctcccaagggcccccctgtccttactgcctaggaaagaacggccccttgatggaatctctgtctgcatgaaaacctaccacgaacactttcttcaaagttctggaaagaaaagttttgacacctgttaaaggaatttcaagaattcaaaattaagtggggacttcccaaagtctcaaataatcatgacacaacctactcaaccatggaacaaatcctgactgcggagcaggacccccagctagacagtgcagagcagccagagtgggtcagacctgagtcctgacccgaggactgctttctggaggtagatatgagaccccaaatatgaacaagatgcactagggacccaggaaccaggagtgctgatatccaaaggtcggggggatgatggatgtcccaattcgagaagagagacagaacgcacccttcctctgactctctgttaagactggcaacaaatcggatgatgaccacctgcattggtgaggatgatcttctctactccgtctactgattcaaatgctcatctcttccagaaacaccagctatctgggcatctgttagcccagtcacataaagttaccatcacaaaccacaaggaatgaattctgctggcacctgaatgagcaaggaaatggattctccccaagagcctgcagaaaggaacaagaccttgactgtaatccagcgagtcctgtgttggagttctaatctactgaactaaaagaaaataaatgtgttttgctttaagctgttaaatgtgtggtcatttgtaacagcagcagcaggaactaatacagccactttaatgagcagcccaggtggctagtacaactgatggggaatgtatcccctggccatatccccaggtgtgtgcccgagagtatcactgtccaaccaaactctctgcagtggtagaaatgttctatacctatgccgtcaaatatggtagccacttgtgaccattaagcccttgaaatatggctagtgcaactaaggaaatgaatttataatacaggtcatcttaattaccttaaacttgaatagccatgggtgatcagtggctcctacaatgaacagcagagcctcaagcagaggttcttaaatgttgctgcatattaggatttcctggagagatttttttttaatgctgatgcccaagctgcctcccagatcaattaaatcagattgcacttaggggatgggacccaggcattggtatttttaaaagtctccaggggttctaacatgcagccaagtttgagattcagtgacccagggaaacggtcacacagggtacacacagtcagatacatggatggtaactgaacccctgccttggaatgtcaacaaatggcaaacgctaaggtttccattcatgcaatggaatagaatgtccacagcaattaaaataaatgcatggatctatacataccaacaatggtaaatacagaaaacacaaagttgacttaaggagcagaaacactagtaacaatacaatatcatgtctatgaactttgaagtgtacacaacaatactacctgttgactataaacacatatagtaaaaagcataaaaacttggacaagaagaacacacaccaactgcaggctgggggaaacctgctgggaaatgagagcaaaggaggggatgggggggtgcaggtacaaagagcttcacttccatgcagcaatttatttcactttagaagatgtgaagcaattatggtaaagtggtattatttgctgtagctccatgttatgaacacaagtgtgttgtcatattttctctattcttttctgggcgtataacatttttcataataacaaaagagaccaacatatggatctccaggcaggaagagtttatccctgggcgggcagcacagaggagggtggttctctggggtgagttaggctatgtcatattgaggaatttattcctagtaggttttccttcaaatggaaagccaattgtcttccagaatttaaggaaataaaacaattatgagccaaaaaaaaaaaaaaaaaaactactggacaacaaaatctggccaaaggtgagtcaggcaaaataaagaagttagaaatggccttagtaaaggcagcatggcagcagctcaggaggaggagaggcaggttggcagggttctctgagcacttaaacataagactatgaggaaataccacaggaagcgggggagcagcggagagcaaatgctatcaacctcatcccacacatgcaacaatttgcaacaatctagccacgggagggaaatgataatattagtgtgccagacactgccctaagtgctttacattataaattataataactcaactgttagaataattctacaagatactgctattacttctatcttagacgtaacagagggaaactgagtcacagcaagtttggtgattagcctgaggtcaagtggccaagatgggatttgaacccagctgtctgggtcccaaatgttaacccctacattataccgttctttgaaattaggtatgcctgcactaatgtcctctgcgcttctacacttgaacttcccgttgtaaaaaaaaggactctaaccacttaaaaaattctatagccttttctacttgactgtgaagcatattcatattctttttcttgttaaagtaaatttcaaacttaccatttatcctgaaagtaaaatgtataatatataactctttggacacacatcctccctttacatccatgaacagcgtgatgtcgaagtcccgctcaccaatgtctatgaggggttatttgtgaaaggtgacattttatgtcatttttcttcttctgtttttccctggctttactgaggtacacttgacaaataaaaattccatgtatttaaggtctacaaggtgatgtttttgtattcaccttgcaaaataattaccataatcaagctaattaacatgtccattacctcacatagctctgatgttttgtacatggggcgagaaccgcactgctgggtgcggtggttcatgtttgtaattctaacattttgggaggctgaggcaggaggatgggttgaagccaggagtttaagaccagcctgggcaacacagcaagaccctatctaattaggcatagtggcacatgcctgtagcagggagacagaggaaatgggtaacttgagcccaggagttggaggctacagcgagctatgattgctacactccagcctgggtgaaagagtgagacctagtctcaaaacaaaacaaaacaaaacaaaacaaaaaaactactctcttagcatatttcaagtccacaacacagcattctcaactatagtaaccatgccgtacgttagatcttcagaactcattcctcctgcataactgatacttagtatttttattctttctacttttctgtattgctggaatgttttatagcaggtattcataaattttcacaacaaatgttcagttaatgacatttctaaaaaaacaaataaaaaagaaaataccaataaatgcacctcctatagaaacacaaggaaaaggaggcgtgccatggacatgaggagggagaacacacctctacatctgtaggacccaggacagtccttctggacccgcaacccagaggactgcaggcaggcagcacctccctgaatccagggtagacagccgggaagggcaggaggaaggccacaggcatggagccagatgaggtcaacaggaatgccatggagacaacagctataaccacagggggaaacccacgctgaaggaagtaaaaatcagaacctacaccctggaaaaccaaactagtgacacaggggaaagcttcagaaattctcccagaatgtcaaaatgaaaaagaccaccacctgacaaagcctcttatggcaagaacagagaggaaggtcacagatgacaaggacaacagagatcaagggcgtttcaagaggaactgctaactcttttccaaagaaaggtgtgcactactgcgacacaaaagcagacccttgctctatggaagaaaatccctctccaccagtgagtacttcagagactgcctgaaatgctccccaagctgttctcagtaaaagcaccaagtcctcttaccaagtcaggaaaacaagcctgcatatttatttggagcactacatttcttggtattctaaaataatatacacctctttctctctctctctctctctcacacacacacacacacatacacacacagagtagataaaaagtcccctttaagctaaagttgggagctcaagtacaacttcaggattatcaataaatatacagctgaccttggaacagcacaggtttgaactgggcgagtccacttatatgtggatttttttccatcaaagttacactgagtgtgcctgcctctcctgctgcccctcctacttcctctgcctcttcctcctctgccaccccgagatagcaagaccaagccctcctcttccttttctactcagcccactcaatatgaagactacaacaaagatgaagacctttatgatgacccacctccacttataaatagtaaatatattttctcttccttatgattttcctattaacatttcttttctctggcttactttattgcaaaaatacagtatataatgcatgtaacctacataatgtgttaattgaccgtgtttattagtaaggcttccagtcaacagtaggctattagtagttaagtttgggggaagtcaaaagttatacatggatttctgactgtgagggaggttgggtcccatcagggctctgagcccaggctaagccatcatatgccctgtgacctgcagtatacatccagatggcctgaagcaactgaagaaccaccaaagaagtgaaaataggcagttcctgccttaattgatgacattccaccattgtgatttgttcctgccccaccccaactaatcaatcgacctagtgacattcctcccctggacaatgagtctcaaaatctacccaccctgcaccttgtgacccccgcccctgcctgtaagagataaccacctttaactgtaattttccactacctacccaaatcctgtaaaactgccccactcagcccacttgcattcaagtaaaataaacagccttgttgctcacacaaagcctgttggtggactctcttcacatggatgcgcatgacgggtcccctaacccctgcactctttgaagggccaaatgtgcattatgtgacatggataaaaattaatgtttttctaaatggcaaagtctacaacctacaaattgaagaatagttctagcttcatctgaagtgttattgaagaacaaaaataatattctccataaatatagcaggcagatatacatttttaaaagtctcaactaaagctgaccaatgcaaacaattatttatttaggtgatcaaatagcaaactgactgtcagagacccattcaacctgtgatatgtgacctatgaattcactttctaccttcatgcttccaaaattatctagattactcactatcaatatttttcaccaagaaacaatggaatcctgagtctggtcacctgaccctatattaaattgtacccatcaattctacaaaacactgcccatgtttcctataaaaaaaaaaaattagaagaataaaagagtaatccacatacaatgtaaagctaaaaaactgcattggaataaaaaacaaaattgaagtattttatgaaaacctacaagaactaataagtgagtttaggttagcagggctgcagaatacaagagcaatatacaagatgcaactgtatttctatacactagtagtaagtaatcagaaagttaaatttaaaaacaataccatttacaatagcatcaaagtctgtaaaataaataggaagaaatctgacaaaagataagtaactcctgtacactgtaaactacaaactactgtagagaaagattaaagaccaaataattgggaagatataatgtattcatagggcagaggactcaatattattatgacatcaactctccccaagttgatctgtagaagtgcttttcaaccacgggtgattttgtcactccgggagatatttggtaatgtctggaggcactgttggttgtccctacttggtggcagaaggtactgttgccatctaatgagtaaaggatgggatgctgctacccaccccacaatgcagaagacagccccacaacaaagaattatccagcccaaaatgtcaacactcccagtgccgaggtggaaaaatcctgatgtacagagttagtgtaattccaatcaacatcccagcaggctttgttctaaaactgacaaactaattctaaaattcgcacagaaattcaaaggatatagcatagccgcaacaactttgaagaagaggaacaaagagaattaacataacctttcaagaggtttcaagaattaagtcaaagtatgttaacagacaattctccatgaacttctgcatatgtggtttttctaaacaagcagcactgtaaaaataaggatagaggatttgaatgccttgaaagctagaagtagtataacgcccaggagagatttagagacatatctgtcttgcaaccatttgctacctttcagtaaaataaaactagggaactttcctcctctccccagagaggatttgtttagattgcagagtaagagtctctccctctttgtctctggggcagaaaaagggcaaagttattagacaccctatagcaattcaggggcctctcctgaacagcactgcacgcacaggggagtaagtggcactgaccacactgtcccttggggaattgacactagttggcactgtgaatataaaatatttcctctgatccagagacattgttcctcatcagaatatatacatacacttaaacacacacacacacacatttttaaaacacattaattaagacagtgtggtgttggcatcaagacagacaagtagaccaatacagtataatctctactgcagaaatagatccacacatatacagaaaaaaatctttgatagaggtgcaaaagcaattctgcgaggaaaggatagtcttttcaacaaatggtgctggaaaaactggatatccatctggggaaaagatgaaataaacctcaatccatatctcataccacataaaggagttagtttcaaatgaatcacagacataaatgtaaaacatgaaactataaaatctgtaaaggaaagaatggaaacaaatctttataactctggattaggcaaagatttattacatatgacaacaaaattttaaatgtggcatcttcaaaacacactgtaaagggaatgaaaatacaagacacattccaggagaagatatttacaaagcatatagctgatacaggtcttgtacctagaacataaaaagaatcctcaaactttaataaaaatgatgtcaacaaaaatgccagagttgaagaccaatgaaaattctctcttccataaaatcaatgagaaaactggcagaaagtgtcagaatcaactttttcagaaccctaaaaattaaaaacagattgcagcaatctgatgagtgcttcctcaagaaaaatgtctgaatctcggtaagaacaggtgagctttgtggcacattagcttggtgctattcccttcccacctacccgtctcggcaggagccttgcaaaccaatagcccacaatcacagtgcatgtgagaaccctggcaaaacatggctggagctccttcaaattctcattcccagagaactgacatgaaatgacctgtctgatgtttctctagaagaaaccacctagaaggctgtttttatttgacctgactcagaccttgctcagtgtgacatgtctttagcctcggggcatttgctgaaaacagttgaaggtgatcattaaccacaacagctgctagaggtggtggttaacaaaaaggcaaaaagaggctaaccaaaaagcttaaaggaaaaagccatggaatgaaacgtctgtaggtcctttgaaaaactccaataaagtgctgaaaattaaaaggccacatgcacacaggctgtgtacatgccaagcactgtgttcatgctcaggaaaggcctgggaaggccctaagctctcatctccgactgaccttgaggctttgcacaagcaggaagggaagacgaaggtagggctgtcaactgcctgcctggctgagtagtaaagtaacatttgcagatgacttccttagaaaatcttaaggaatccacaaaaatactgttagaggtaataaatgagttcagcaaggtttcagggtacaaaaatcaatacacagaaatctgagattcctgtacatgtgcaataaacaatcaaaaactaaagtgaagaaaacaattccatttataacagcataaaaaatacaatacttaggaataaacttaacaaaagagatataacttgtacactaaaaactagaaaagatcattgaaatgaattgaagaaagcttaaagaaaagacatcccatgcttctgagctggaagacaatattgtttggatggcaatattctccaaaatgttctacaaattcaacacaacccttataaaaatcccagctagatttttttttttttttttttttttttttttgcaaaaatggacaagttgatcctgtaattcatacggaaatgcttggatccagaatagccaaaacaatcttgggaaatcaaagttggaagattcacatttcctgatttcaaaacttactacaaagctactgtaataagcccatacatttatagtcaattgattttcaacaagagtgtcaagtcagtataatgcaaaaggaacagtcttttcaacaaatggtgctgggacaactagatagccacatgtgaaagaataaaattgaacccttgtctcatatcatatacaaaatttaagtcaaaattgatcaaagacctaaatataagaggtaaaactatgaaactcttagaaaaagatatagatgtaaattttcatgatgttggattaggcaatgttttcttagctatgataccagaagaacaagcaaacaaaaaaatagatgggatatcatcaaaattacaaattttgtgcttcaatggacaccatcaagaaagaaagacaatctacaaactggaagaaaaaaattgtaaatcatatgtctgtacaggtctagtatccaaaatacataaataactgttacaactcaataataaaaagacaactcaattggaaaatgagccaaggatttgcatagacatttctccaaaaagagatttgaaggaccaataagcacatgaaaagatgctcaacatctctagtcaggagggaaaagcacatcaaaaccacagcaagaaagcacatcacaatcacaaggatggctgtaataaaaaaaactagaaaatacatgtgttggtgaggatgtgaagtagaacccccacacattgttggtaatgttacgggcaggtctttgttcttagagctcccaagatgtggcagaccactcccaagatggcagcaagccttttgttctctgacctggggttcttggccttatggattccagagttttatagctctattagaagccgtaggtcacggaagagaaccatggaacccagcgactagtgttcagctcgattaggatgaacctgggcactcagccgtgcaggaacaatggcgagcctttagcccagtcggaagcagcaatgggcgcctcgctggatcaggagcacagcagacaccctgccagatctagaggggtgtcagtcagtggcaggtctgcaatggcagccaacagcagtggtggacagcgagcgaaagctcagctcaagccataacaaacatggaccagaagagtgtgcagttgcaagatttaatagagtgaaaatagagctcccatacaagggaggggacccaaagggggttgcccactcccggctcgaatgcctgggtttatatcccgatcattgtccctccccctgtgctctcaggcgatatatgatttcactatttctttacctcttgctttagcctagtttgtattttagtgagccctctttactacctgattggttgggtgtgagctgagttacaagccccgtgtttaaaggcaggtgtgatcacctttcccagctaggcttaggaattcttagtcggcctaggaaatccagctagtcctgtctttcagtaagaatgtaaaatgaagacactttagaaaacaatttggcagttcctcaaatggttaaatccatagttacatatgacccagtaattctattcctaggtacatacccaagaactgaaaacatgtgttcactccaaaacttgtacaggaatgttcacagcagcatcacgcataacaaccaatgtccatcatgcgatgcatggataaacaatggaatatacaactgtttactggaatactattcagccataaaatgaaataaagtattattagatgctcacaaaatagacgaacctcaaaaacattttgctaaatgttaagaaaatagaccactaccaaaattctttcaagaggtaaatgagtaacaaactgtggtgtagccacccactgggatactaccaggcaattaaaggggctaaactaggcacatgaaacaacatggatgaatctcaaaggctttatgctgagtgaaaaaggccagtctcaaaaggttatatgcggtataattccattcacataatattccgcaaaagacaaaactatagtatggagaactggtcagtagttggtggctggcatgggtttgagaggggtatcacaagatgaagccattttacaaggtaatgaaactggtctctaacctgattttggtgatggtaacaggaatggatacatgtattacaattctcagaactgtatacccagaaaacaaaaataaaaacctaaccacaaacagaaagtaaaaacacagaaataaggccctcctttcctgacatgcacattctttagtaactacgaaagtaatttcttcaacttcaaaaagcacaagtttaactgatttatttcaagaatgagctaatcaattctgtatttattaaatgcaaatgtttccaatgggtagatttaatatgctatggcaggagaaaggtacattctataccctgaagtacaagaattgattgtgcaagcttggatgcaaaaagtaaaattaaaattccatgtacgtgatatagtgctacacctggcaaaaagcttttctgtagagtgaactgaaaggcacttgcaaacaactcaatcatctggttaaaaaagaaaagaaaaaataggatcacaactctctcttgttacagggaaagtgtccatcttccaaaaaccaaggctcccctcacgcttctcaaagatggtgtccctcttggacagcctctgactctccacatcattccctctttcctccaacccccactgataaattcccaccttagaggcaagccacagcccacagactgctacttcttaatctccccctgtacagagtattttctttttttcagagacagggtttcattccatcacccaggctagggtgcaatagcgtgatcatagctcactgcagcctcaaactcctgggttcaagcaatcctcccacctcagcctcctgagtaacagactataggcacatgtcaccacacctggctactataaaaaaatttttttttttttaaagatggtgtcttaacgatattgcccaggctggtctcaaactcctgggccatagcaatcctcccgcctcagcctcccaaagtgctgggattacaggtctgagccactgtgcccagcctggaaaggatcatgtttgccccataccttcccatctttccagtcgtgccaacctaacacccccagagaaccatgtctgcctccacactcccactctcccttccatcactcccatctggcctcctcactgattttccacaaaacctgtcctcaaatggtcactaacgatctccatgctgtggaatccggggggcacgtgtttgtccatttgctcagcttctcagttgtcaccaacccatttggccacactttccttctgctgatattttctgctttcaacatccttgaaaccacaccctcctgcttttcccccagatctggccacactttcttggtttcctgtggcagctcagcctgctctcctgagcttctaaatactgaggaaattcctcatggccaggccatgcccccgtttctccacactcttcaatttgttgcctgcctgcatccaatgccatccgtatgcacctgctcgctctgtttcatcggcccaacctttgctgggtttcaggacattttctaattagtctgtgagatctaagtagatgtcccattaaaaagggggttccatgggaaaatacctttgagaaacactgcttcacatgatgccccccagccaccccacgatcagctgatgagtctttaggaaaacaaatctgtctaaaacattcctagaaaaataatcccaacaatcaatagtttgtgtccctgttgtaggctcaggtatttcacaaaatccttctcatcttccccactgaaatttagtctcgtgtgaaatgaaacacagaatttactactttactcctaggtaattcccaagatcacctgcctcacttcctccccagggcacaaaatcagagatgtgccaacagaaggcatccactgcagaccctgtaatcttgccaccaccattcttcatgagccatggagaagcttatagaagctggactcctctccccagaaaaataaacacacacacaacacacaaggatctgtatgtaatctcaaggtctcaccccaggaaattcaccccagggtccatgaattcaaagtaagcccccctcagtaaggatgcttcagcggacccctctgattcacaggggtctccattctcacgggcttgctggtttcgctgctaagattatgacaaactagggctgatgagaccttgcttcactccagcaacacaccagtgcaccataactgaggcctctctgcacacatccgccctgcagacaccgtgcattcatccatttggcaaacactcactgagctcccctaccttccaggtgctgtgctaggtgaaggtgacaaactccatgatccttgccctggggagcagacctcctggtgaacagacgcaaacaataagcacaacaaatgacaggttgtgatggcattataccaaaattcaaggggtcatctgacggggtcagatccttgatattgggtggtccgtagtatcatgtgacagcatctgagattgcattccataaaaatcccatcaagatttgtaaaacctcaaagtccttcaaaataagaagatacagtctcaatgttaaaggctgaccaaaaaaaaaaaaaaataggatgagttggaagagaagctgcatgtccttccaaactaatgaagtgatgctcctcctcttggctccccactcccagtagaaatccagccgctagtacccaagtgagagtgacacattcctgcctagcaagcctacagtacagaccatctggtccactggccttgtgcccacttgaaagataacaagccagtttccaatgataaaggaacccaaaaataaagatgtaaaaacagagcccctgaaatgagtcaaatgatacttcctcaccaaacacatcttctgatagcaaatcaagtccaaaggtctcattacaaagaactgtaattctagatagtaggattagctccaccatgaaatctatatgccaacgctctttcgtaattcacttaaaggcccactcacaggtaattcacttaatttcagatctctgcacttgaaaatcacattttttgtgtttcaaatggaactgtctaaactccatccatcgcagaacagttatatagattatgttcataaaattttgtatatacaaccattaaaaataactgggtaaaactatgttactcaagtgatatgtattgttttatctgcgtaaaactctattcttcttgtaaattctcctttgtcccatgtgattgtacttgaaacttccaattatactctttctagcccctccccagccactgtggctagtccagagataggaccatgacatgaaaccagcctatttgagtcttccctgggattctccaacctgcaaaacaaaagcctcttgcatgtccggtcaaggagctgtgggcacataagctcccaagagctgcaagtggcagagggtccacataaaggtggggttgtgagggcgtggaggggtgtgtgagggtgtggaggggtgtgtgagggtgtggaggggtgtgtggtagctaatccagtaaaggcacaggaaggctacgcctcactcagtttctgagtatcttctctatgaagtcaaaagaagtttgaggatgattggtgccattggtgaggcaggttaagcatggttaggactggctagtttgaagaatccagcagcctctgggctggaggggctgtcatgagttgtctggtacctggctctgaggtgtttagggctggtggaccgtggcctagaaggtgagagccagaagaagtgctggggaactgggctctaggctggctggtttgcattctgaaaggctcactcacaggtgagccattaccacctgcaggaatcagctagcctgggagggacagtccctccagcatcagcaaggccccagatgccagagcacccaaatatacagaataaaagggcacaatgaacacacaccaaaaccttgtctcacagagaatgacacctagagtggctgattgacttgaccaagctcaaatgagctaataaaatttctaccttagggtttacacagcacttacaaactacctcattttagatatagcaaaaactctaaaacatcacaggtttatggccattctgaatctcaggaaaaccgaaggtcagagaagttaagcggtgtttctttagtcatctgactaaagacaaacagagctaaaatgaagctacatcttcttgtctagccttttgcatggattcttcaccacacggcctctgcagacctcaggccccacctaaagctccattctgatggatgaagcccagggcccctcgtgcttataagtcttggttggggtggtctttcccgctcacatctcccatgctcggatgtacggaaggcgcctaggtggggaggggacgctccagaaaatgcaaagctcttccgaacaaggctttagtatccacctgcagctgccttctcaccctagggaactggactgaacaacttagtgctccctgagcctcgcccagagcaatggttctctgggaatctgtgcgggtgctgggttgtcataatggctgtgtagttcctgacctatggggaaaagtggccagggatggtagccatccatctatgcaaggagtgttaacctttacgtgttaatgtaggtgaaacaccaacttataataatcacaacctaaaacttgcttccacttttaacctccaggagttttctcattgtttttatatacactaaggtgcccggcactgcaactaccagatcgatcaagcgaactccaacgtgtctggaactctaccaagagcggttcaccactttggaaaatcatgtccccattgacaaggacactccagtgcaacatcctgtcctgctgtgcggctgccgtcatgtctgtggtgatgggtggaggtgcaagcacccagtcgttccctgtgtctcccagtggtcaacatgcctaagcacagaaacatacattattttcagtgaaaattacatttagggctttgtaatgctttttggaatcgtaagtgagaatacggtgcactttctatgacttccatttggggatatagcaaaaacatcatgacaaagggctgtggatctgacagagttccaaccacaggcccagagcagactctggccagacacctcctgtagcctttcctttgagccctgtccttgatctcgatccagttagcatttcaaggttcaaatgcagacccatcccaaaacggtgccgcacccaagtctgggaccaatgacggagagaagagggaggcacctgcctgcattcttcccctcagtggctctggccacacatggagtcgtgggctcccctgtgcactgttctcagcctcaggtaggctgtgttctaccttccccccagttttcttcttacctacgagggctcttgatttctcctgactttgcaaatcctttatgcgtgacagtctcgccttgagaagacagggaggtaggggacgggaagccagcaattttacccactactgattcattcaagaaacacaaatctgaatgcctactattcattttaccagggctctttgcagacacgccagactttcaaactagccatcatcatttaacatctttcaggatttcacattagaagcttttggtaactgaaagtggactggtgtgggggagggccaggtcccactctgacaagggcctagaagacaggccaactcctgtctgaggtctgaaactgggcagaacatgaagggcagccctggggagggccaaccatggggacggaaggcaaaaggctgtgggaaacccatttttaaattttttaattcatttttaattgacaaataaaaattgtacatatttattgtacaatttgtacaactgcacgtacttcaacatgttgtttgaaatatgtaaacattatggaaagcaaaattgtttctgaggcagggtctcactctgtcacctagactgcagcgcagtggcgcaatctcggctcactgcaacctctgcctcccaggttcaagcgattctcctgcctcagcctggggagaagctgggactaaaggcacccaccaccacgcctggctaatttttgtatttttagtagagatggggtttcactatgttggccaggctggtctcaaacccctgacctcaggtgatccacctgcccctacttcccaaagggctaggattacaggcgtgagccaccgcacccagcttgaaaggctaaactgagctaattagcatatgcattactttgcatccttattttttgtagtaagatcacttaaaatctactcagcaattttcaagaagacaatgctattaactatagtcaccatgttgtacaagagatctctttaacttcctcctcctatcgaactgaaattttgtatacctcagattctaatttttaccctatattacacagagcaattttgaatttatttcgctaaactgtgacctagagaaaatattttattcagaaaacatcactggtaaacaaacagctcaggaagtgatctgtgtttactaaaactttgaaatatattttacacatattctgcattaaaatctgattaaaatgtagttatacaaagagacagtgttttctgatttgtagcattcatggccgagatacactatttaaaaatgcacttgatttaggcatttattcaaaatcataagcataaaacatgatcataccttcctactggcagacacaaaactggtgcatcccacacacttgtttgagtaattacaacaccagctgttctagcacctaccaagagaagctgcaactcagactgactcctggtcactgatgtgccaaacagcatcatcttctaaccaaaaatgaaaatctcactttgataaatgggttgtccaagttaaattagctaaaccaatgcttaagtctaagttccaatttttaaaactttctgtatatgctatactagcaaatgtggatttatctgattttaacacaaaaaggagagactgccaatagaattgatttctgctagattttaaaatctacaaaacctgagatctccccaagaattaaaggcaattctcaggttgaaatatttatgaaacatacaaatttcaatggcatttcacagaaaataaatataaagcattaaatagcaagacaaagattacagccaagactctcaactatccaactgaaactcacttccatatttaccacccaaagacagcagaccctccatgtgctggagcctctacaggaggaaggggaaatggccatgtgctcagtgtgtgttccaatccagggattgtacacaggctactttattcaattttctctgactctggatttcccacaggataggcttcgtagcagcactctacagttggggaaactgaggcctggcaactcccctaaaggctgcccagccaggaagcacccgcccagcaggtctgacgaggcctccattctcttgcagtgcgctatgtctatccactccaaaagccacagcacacacaacttcaactctccagaaaatgtccagtcaccctgtctatatttttcttgtttcataaaaattacgcattttggttggagtagacttatgaccagaaagaggctctctgcaaagcagatgctgcacttgcaatggtgggatgaagggggatggaatgcaatagcttgaaaagtgaccgggacacagcagctggactagactcggggataagaaatacctctctatttttccccaaagttaaatatttctaagcttccacctgttcacctggtgagaaatagcatttcttcatggagtacaagagtcttaagtggtatatgcaacccagaaaatttggcaaacggtccatgatgatcaccattgagctccctgcccataaggtccattgtagaggccctgaccctggaaagtgttctgtctgcagacatctgtggccatcctcaccttggaatttccccttcttagacgagccagtctgacatcagtaaaaaacagaagtcaggcatttctcccctgtagaaagggaacctcccattctggcagaccaagattcaacactctcttggaaaggaagaagggaaataccactcatgcctgcaatgagccaacagcagaccccagtaggcccaaacaatgagaaacaggacagagtttgggtttgctttacatctattccattgtgaaatgccagggccccaggactccccacggctcaggaacgtatggagacgcattaggtggcaatatgtgctgctgcctatagaaacgatatgtgacccacagaaagagtgtcatatgtccaacctaacaccacaccagtgggtcacatctgcaagtgccccttggccaaaaaaaaaaaaaaaaaaaaaaaaaaaaaaagaaggatatgtagccttgctctccttcctaatcaggagctcaccggaacgtgggagccaaccaaaccaaactgtggctccagcttttacaaccctaactactgggaatctattttctcgctggagtgtctgagaggatggagaaatacacactaaaaagggttccgtggagatattggatttagactttataaatgtggctcatgaattccaacacccaaaatggaaaactgggcttccaggatattatactgttttgtacttagctactttatttatacccctcctggttctgaagaatatttaacaggttttatttcaccatgaaaaaaagggttgctttagcaacagggcaaacaagtatacttcttaaatgtctataaatgacccagattagtctccaagtttgtaaaatacttaatctctttcagcaatgaaatgccaagataagagtaaattccaaaaattcttttgagggcatgagggcttacttattgttaagtaggagatgagctaagcctctggtactctcggtccacagaggcaccctataaaaacgtggcaagcccagggcgaggcatcatggaatggaccctgaattctacctcagtggtgccaattcctgagaccttgttaccacaatgtggccaggcacaaagttttcactggccaagacaaaaataagaatagttcccagcacaaaaaaaggcaccaataagtatctgtagactgatggactgataagtgaatgactgatactgtatacttttcaaaagtcaagagataatttattacatgtgaagaacaatccttaaaaataaagctggggccaggcatggtggctcacgcctgtaatcccagcattttgggaggctgatgcaggaagatcacttgagatcaggagtttgagacagcctgggcaacacagggagacctcgtctctataaaaaaaagaacttaaaaactagccgggcatggtggggcaagcctgtagtcctagctgctcaggaggctgaggcagcacaatcgcttgagcccaggagttcaaggctgcagtgggctatgactgtgccgtttgcactccagcctgggcaacagagcaagacatcatctctaaaaaaataataataaaaataaagtaaaaagctaaagttgaacctgagagtgtcccttataacattctcctaataaaatctttttctttgtataataaaatggtgtgataaaagacaatagtttcagtgtgaataaaaactaaacagtaaggccaggcatggtggctcatgcctgtaatcccacaactttgggaggctaaggcagggggactgcttgagtcttgagcccaggagttcaagactagcctggtgagaccctgtctctacaaagaaaaaaaaatttttttaattagccaggtatggtgataagcacctatagtcccagctagtcgggaagctgaagcaggaagatcactcgagcctgggagtgcgggatgcaatgagctgtgattgtgtcactgcactctagcctgggtgataaagcaagaccctgtctcaaaaaacaaactacccaaaaagttagcaactttatgtctgaaccccaaatattcttttttttttttgagacagagtctcactctatcggccaggctggagtgcagtggtgtgatctcggctcaccagaaccccaaatattctcgaactttcattttaactacaaaatctgacagtgtgagaaccactgcttgaagcactggctacaatcccaggaagaagagtggaaatccaagacacaggggctagtcggaaaacattccccaaaggcagggaggcagacccaggcggcagaggagcctgcccaacagccacgttccctcttccctcggacagatccccagctttgttagaggatccttttcccatgtgactcaaggtcaagtgaatctacctcccactctaagaaaaggtcagtattagctaattccccttgccagtgattggttcagggatgatcacatgacttaggtctgaccactgaggggaagtctggtggggggcttctaggaaagatttccttgccactaagaagagacacagggatcagtaacccctcttcttttgtgtacatgtgtcctctgattctggtgcctaaaactacagcagccttctagctggattcaggttaaattaagatactcttaccagcagagcagaaagatggaaaacacatgggtacttgataatgtcaccgaggcactacattaaccaactggaaacctgttatggttgaattctgtcccccataaaagatacatcaaagaattagccaggcatggtgacatacgcctgtaatcccacctactcaggaggctgaggcagaagaatcgcttgaacccgggaggcagaggttgcagtgagctgagatagtgccactgcactccagcctgagcaacagagcctgactctgtctcaaaaaaaaaaaaaaaaaagtcaaagttctaaaccctagtacctcaaaatctcagaatcggagtttatttggaaagaaggtctttgcagatttaaccaaattaagatgaggtcattgggtgggctctaatccaagatgactggtgtccttataaaaaggggaaatttggacacacataccatagaaggatgtggtgaaaacacacaggagagccccaggtgaagacggaggcagagactggactgctgagactgcaaaccaaggaatgcccaaggactgctggccaccaccagaagccaggagaaaggggaggaagggatctatctacctggagtctcagagggagcacagctctgttgatgccttcaggttggacttccagcctccagaactgtgagagaagaaatttctattgttttaagccacctaatctgggcagctctagcaagctaatacaccttctttcttctggacctttttatgtatacgtaacataatatatgtatactatgtaaattaataaattttccttctgcttaagccactttgagtgatgatgtcagtaattgcgattgaaggcaactcgatcaactggtcccaagggaggggactaccaagcagagaaagggtcctaaaggagccaatgcccactagagtccacgcaccgctttaaccagccagcaccaacatccttccttcatcccaaactcacaccgccagacacaaacacaaattgctgctccacacagcatgccgttatccttatatatacaaccaaaagcacacaccacaaattctagaacaagtgcaggacctcaggagaggtccacttcccctttggtttcctcctgattcttcttttagtctaatgtagagattaaactgtaaagctgaggaccagccacgcaccctatatacagtacatgcaaatccaactatttctcctcaaacccttggcctggcccagggccccaccatctctctctggatcattgcattagcctcctaactggaatctccactttgcgaccctggccctccttcaaagcactctacagagctgccaggatgatccggttagaataagttaggtcaggtcactcctctgctcaaaaccctccagtagctcctgtttcattcagagaaaaagccaccgtcctcccagtgactcaggaggcccctactgatggggatccctgtcccatcattgtttcccattgctccccctcttcctcactgcactccgctggcctccttgctgtcctgtgaacaacccaaggcggttcctgccttggcctctgcacttgctctgcccttctccacacttctgcaggtcgctactgaaaaatcacctcattaatgagggcttccctagccatcctttctacaaaggggccttcccaacccctttccactgacccttcacaccccttctcctggatttaacaatacgttttatttatgtggcatgttcattgtccactagaatgcacgctgtaggagggtggggatttttgccaaccttgctacatcccacagcagtgtctgggatagggtctgccacatgcttgaatgagggagagggaggaaagaagaggtgggtgactatgcatgtggttggttaggtcacttagcacggccttgtgttttgtcccagtcatgttcagctgggcagctacaggcctggaggaagcagagagttcaattcagcagggctggagttttgccaacagagtataaggaaggagagaagagccagagagctgaagaggcaaacgatgactgatcataatggctgaactcggaaattattataagttaggtaaagaaggaagtgagggcatgaagagaggacaacatgaaaagataatcaaaggtttatagatcagtgtggggtttaagatcttttgggccgggcgcagtggctcacgcttgtaatcccagcactttgggaggctgaggcgggcagatcacaagatcaggagatcgagaccatcctggctaacacggtgaaaccccgtctctactaaaaatacaaaaaaaaaaaaaaaaaaaaaaggtaggggcgtggtggcgggcgcctgtagtcccagctactcaggaggctgaggcaggagaatggtgtgaacctgggaggcagaacttgcagtgagccgagatcatgccactgcactccagcctgggtgacaaagcgagactctatctcaaaaaaaaaaaatctttctggagtaggtgcacctacattgataatttttgtgtaatctaaaattgtgtttgttcctccttggtctaacaccctcagattccaccagcatatatattagccaagtttgcatccatgtatattagcaaaaattcagttcaagtggcacgtggcatgtaagctttctccctgtggactttataatggcagctgcaccttccctgctggggactgacttcagtctggatatgacaaggggtggtgagggagaaacatcgggagactgccttcccaggtgagatactggggccgggtggaaacgctgcacccgacagaggtcccagcctgcctgggttggcaagcacagttgagagggatcctgagtctcccaatcctctccccaccccccacccccaccagcatccaccagagtgtcagacctcatgcttcctaaatcaacgacagtgttcgggaaccaggcaaggccatgaacacaactgctggtgtgctcagcaaccagaaggatcacactctgaaaccctctgctcctttcttgttgcccccgccttttgtttcagtgcaatcactgcaagttcacgacatgccaggagctgaaagtttcagaatctgggctctgcattctttttctttaagctaatcagcaggagcccctgaatatccaattccccactgcctgccatggacggtgaggagtccaccactcaaccctggctgtactttcactagctctgcccttaaactgggcaaattaccagtcccacatgccctgcccctatttcctggagggtctaccacctgcctccactccttattccaatcctgccttgttctgggttttgacttccaagcaacagaatcaagttggcagagcaaggtggaaaatggcatttacctaaacaatgttggagagggcccagaatcgctaggagggcaaaaggaaaggctgaaggctacagagccaagaacagtgccccacatcctgcccagagcagccaaaatcccctgagtgacaaatgacagatgacggatgacactccaagccaagccctggcgagccctcacaccatgccagggctgcccaggacgcccacctagctgcaaacgtggccaccaacagctctctcactctgtttgcctcactgcctcccaagagacaaagtctaggcagatgtggcccaggcaggccagtggctcccgtgcacccaggatgtatggggatcactcagtttgggtcatatcacagcccattgcctccctgcaccccatactcctgacaccccagcctttctgggacccttatccacagtcttccagtttaaatgaaagaaagtagacctcaaagacaggccaatgtattgaatgtataataatcaagccagggtatccatcaccctagtgtttcccatttctatgtgttaggtacgtttcaactctcttctcgctatgttgaaatgtattatacacactgttgttaactatagccactctactctgctatcaaacattagaacttatttttttctatccaactgtatgattataccccataaatatgtacaaatataatgtatcaaaaagaaagaaagaaagaggccagtggaaggcattcaaaaacaacacacaaacctgacaactctgttttcgcccaccagggctcagtgaaactcttcttaggcatcacacaagagagaaggaaaactggcaagttcacaacataaacacgccgagacaggtagacataccgctaactttatggtgatctggctatctgaatagaaatagaaagagtgctataccatgtcaggagacgaaaacctaacactttgcctgccatctataattgcttgacagcataattgatcatgtaactgacaactgtcccatcatcctattctcaagcactgataaagtgatgtaacactaccaacggcacatgggatcttccctaaacagtgtgatctgcaccaaccagggatcacacagttaataccactggaattttaaaaagctttctctaaacaaaagcatcaaaaagctatcttaaaataaatgaaaagcagacaagttagtcctatagccttgagtatttatcctagatgatgtcctagtggctagtgaactagaaatagactctatctgtggaaatgagggaaatattttttaaaataacaacgcccattagaagaatccagctgccttctcaaaatgacagagccagagcagttctttgtcatcgctatggctcggggcctggggatcacaaacctccaggtattcaccgggtctgcactgaccagaaagcatcactccctccctatgtcaggcatttggacataatgtggatggttaataaaaggcacagcaagctgagaaagactcaccagacccaccttggaggacccaacaactgacccggagcacactgcggaaatttcaactcatctcatctgttcactcgctccttccgtaaatcggtactgagcacctgccgtaggccaagcacggtcctagaaacaggatggacacagctaccaaggcctcagcctcagcctgagggagcccatgttccaggagggaagacagatgagaaacagaatttaatttcagatagtgaggagcatgtaacagaagacaagagcaagcggggaggacacagggcaggaatgcgggctgggagaggggccagccatccagaggagaggcggggagagccttctctgaaagggactgctgggtgagacgtgaagcataagaaggcattactgggacctcggagtcagcttaagggcagaatctcacacccttgtcttagaaaaaaggaatgagaagttttctagacagggaagaaaaggcacccatgcttaaaatgggagggaacaggcagagttcaggtgactgcaagaggccactgtggctgggcacagagagcacacaggagctgcacaagacaggtctgctggtggccacagagccaggacagcgaggtcgtggggaagaaagggaagggctttaagctgctggggctgacacagtcagaactacaacacacacagaaaagcgtaacaggtctttcttcttccaaataagcctatcttttacgcttttctgaattagttggtcctcctgttttggcttgaagtggtagggtttactctattttttggcttgaattggtagggtttattggtttggtttggtttggtttgagagtctcgctcttttgccagactggagggcagtggtgcgatctcggttcactgcaacctctgcctcccaggttcaagcaattctcctgcctcattcagcctccagagtagctgggattacaggcgtgtgccaccatgcccagctaatctttatattttttaagaagggacggggtttcaccatgttggccaggcttgtctcaaactcccgacctcaggtgatccacctgccttggcctccccaagtgctgggattacaggcatgagccagcacacccggctgctttacggagtctcactctgtcacccaggctggagtgcattggcgtgatctcagctcactgcaagctccacttcccgggttcacgccgttctcctgcctcagcttcccgagtagctgggactacaggagcctgcagccatgcccagctaatttgttgtatttttttttttagtagagacggggtttcactgtgttagccaggactgtctcgatctcctgacctcgtgatccgcccacctcggcctcccaaagtgctgggattacaggcgtgagccacggcgcccggccctccttagccatttttaagttacggttctacggcacaacgtacattcacattgttgtgcaaccatcaccaccaaacatgcacagagctctttttatcatgcaaaactgaaactgctcccactgaacactgctcccctgctgtccctggaaaccaccatcctacttcctgcttctatgagtctggctactctgggtacctcatataagtggaatcacacagtatttgtcctttggggactggcttatttcacttagcataatatcttcaaagtctatccatgtcatagtatgtgtcagaatttccttcctttttaagaatgaatagtattccatggtatggagagaccccattttattgatccattcatccaaggatgggttcctgggttgcttccacctcttaactattttggttgatgctgttatgaacatggataaacaagtatctcttcaagtccctgcttttaattctttgggtatatacccagacttgcttttaatgagactctctacatgttaacttcttgcttttaatgagactgtctacatgacatgttagtcacatgtgatttacaacaggaggtaagagcaggctgggtgaatcataatagtgtccattaatgctgcacgtacacagaggactcctatggtgccagtgaacaaaggagcagacacctgctcccaggaccacacaaaactcaccactgcagacatagatgactacctccattctaacacataacataatttggtctcaggtacttagtgaggagagtttccatttttcctccaaagatacctagcagagaaagaatgtcatgtttgatgggagaatttttaaattagcttcagaaaccaattacatacctcaggcttaaaaaaagacagcaaaattggacaggtgcagtggctcacgcctgtaatcccagcattttgggagctgaggtaggtggatcatttgaagtcaggagtcgagaccagcctggccaacatggcaaaaccctgtctttactaaaaatacaaagattggccaggtgtggtggcgggcacctgtggtcctagctattcaggaggctgaggcaggagaatcgcttgaacctgggaggcagaggttgcagtgagccaagattgcgccactgcactccagcctgggcaacagagcaagactctatctcaaaaaaaaaaaaaatcccccaaaaaactttttcaaacccacaatctgactttaaatttcataaagaaggtgatcaacaaagattggtcttggtctattaccaaaatgatgtcaaattttccattctctttctttgttctttacatttccactccgattttatgtaaatgaaattgaacttttactagagctgtttaaacacattctattgaatacaactgtattttatattttcttttatttttatattatataaatttgtatttataaaacagcttttattaaaagtatttttgctctgaataattgtattccatacatgtaaatataaaaaattgctacatggccctttaaggcatttaataattttacaaaatacagtaacactgcagaagaaagacataagaagttttactgttaggaacattctccaagccagaaaaataggcattagagtaaggacatttccacattcaatattaattgatatttggagcagaataattcacagttagtagtcagattgatagagacaggaggtataacagtggttgccagcagctgggggcagacaataggaaaatgttgaaggggtacagagcttcacttttgcaagatgagaagttctggaggtgtatgatgttgatggctgcacagccatgtgaatgtacctactactgaactgtacactttaaaattgttaacatggtaaattttatacatgtattttaccacaattaacatttttttcttaaggttttcaaataaaaaattcggtagttatttgaataactaatgctaggcaggactggtcagcaggaaaaagctgctccaaaggtggctgagggtaaggaaagccttcgtaacccctcaggcaaatcaacaaagagatcttttactacaggaaggtgctacatctgcctcagagcagaagtggtgcagcactgatttaggttctgaatttcttaaggtctaacactgacattcttcacatgctaacagttccgatgttcaggtgcctcacagaagcaatgtcaaaagaaatatgctatctgccaagcaaagaaacaaactgagaaacagctgtgtctgcctgtgcatgcataaacttaaccaggcataaagggttcctagtgacacgtatctgcatggcagtaccacagagtactgccatgtagttgaatttgaattgtcccgtaaatgcctccaaaaagatttcatgatgatatacaactgagactgcacactactgtgtggacagaaggttgccttccatcgggctaagctccacaattaagtaaaaactgccaaatcttttgggcagatcataaaatgttcgaagtcaggacaagctggtgagactgactcacacactgtaaggactatcactgaacatttttctgtcctaagtcccagctgactttccatgacagttgtttaatttccacagatacataatgcaattatggaaaaagtgaaaatccgatatttaccaaagaagaaatgcagacatctggtagtttttaaaatgctttgaaattatgctgtcaatgctaagaggacacaaaaggtcaagaacatgagcatggaatatgaacagtattaaagctgtcaggcaaagctatcaatggccaaaagagataacagaaaacattatcctatgaatgaaaagaaagcttaagagtccagttttgtgatcttgagtaaaacaacagtatgatgtgtgggataaatgtagctgccactgggtagatattttatgaaagctttgtttattatagtatttcttttttctaaaacaatgctgcttagtggagggtaggctttataagagtaggtacatgactagtcttttgctgcagtgatttagtttgtgatgatccacgtcatttttgccacagtgtacaatagctgctgaaggccacccttgtctctcacttttcattattaaaccaaagcaaactcttctgatgaagttagaatacatttttttaagttagtcaaatgtggacactataaatctaacctctagtactatggataggcaatggaaaacatcttgaaatgttaatcctaaataaacactaagcaatgtttaatgtttaagattgatgtcattgactatgcttagctgagaagaaaacatgtgattaaccaagggaaggacttaaaggatatgtaataattctatatcaccactagacatttaaatttcacaaagaggttcaacaacttgaggaagctactgctgcctttgccacagaaccttctatctcaacaatgaaactctatctcattgccctctatctcaacaatgaaacttaggagacttctgatatgacacattgggagatcactttatgttggacactcaaaatagaaagcctgaaatggtaccaaaattgacagctctaatacacaagggaaagccctaccctgtgacactgtaatattaaagcaagcatcttttttaagataaaagtaccacacagtggaaggaaagcaatgaaacatctgcagaccctgagaacaaaagaactccaaaatcgccaacagataatcagtgcaaagtgctggagccagtataaaaatgcagagtccaatttgcaaaacaaaactactgggagtagaaaccaacttgggaagaagataggtaataggggtaaaaaaaaagaaggaaaaggatgatacaagtggcagactagagaagaggagccagatgtcaaaaagtacatggccaaaccaatcgccactttgtgaaaataacgagaatgtgtgctagagctatgaaactagaaatctatcctatatataaacagataaaattggccaggcacggtggctcatgcctgtaatcccagcactttgggaggccgaggcaggcggatcatgaggtcaggagatcgagaccatcctggctaacatggtgaaaccctgtctctactaaaaatacaaacaaattagctgggtgtggtggtgggcacctgtagtcccagctactcgggaggctgaggcagaagaatggcatgaacccgggaggccgaacttgcagtgagccaagatcacgccactgcactccagcctgggtgacagagcgagactccatctcaaaaaaaaaaacaacaacaaaaaaaaaaacggatacaattagaagatgaaaagatagaaaattttaataataaaaaataaagagatatggagcattcaagagaaagggataaagaagacaggtaaagagggctcaacatatgtataaaaggaattctgcaaagaaagaaacagaacaaccactgaaaactacatattgactcaatttttttttttttttgagatggagtctcgctctgtcacccaggctggagtgcagtggcgcaatttcggctcactacacctccgctcccaggttcaagcaattctcctgcctcagcctcccaagtagctgggattataggtgcatgccaccacacctggctaatttttttttttatttttagtagagaccgggtttcaccatattggccaggctggtctcaaactcctgacgttgtgatccacccgcctcagcctctaaaagtgctgggattacaggcgtgagccaccagacctggcccacattgattctatttttaaaaatgagtaaaagacttgaatagacatttctcaaaagaaaatataaaatggtcaacaagcatatgaaaagatgttcaacatcattcatcattagggaaatgcaaatcaaaaccacaacaaggtatcacctcaccctcatcaggatggctatcattaacaacaacaataacaaaacataataacaagtgttggagaggatgtggaaaaattcaaacccttatagactcctggtaggaataaaaaatggtgcagccactgtggaaaacaatttgtctgttcctcaaaaaattaaaattaggattgccatgagatccagcaattccacctctggatatatatcgaaaaaatggaaatcggggtccaagagagatatctgtacacccatgttcatagcagcactattcacaatagccaagaggtggaagcagcccaagtattcactgttagatgaataaataaaatgtggtatagacatacaatggaattcagcctttacaaggaaggagattctgatacatgctaaacatggatgaatcttgatgaggctaagtgaaataaggcagtcacaaaaggacaaatactgtatgattccacttctatgaggtatgtaaaataaccaaattcatagaaacagaaagtagaaggggagttatcaggggctgggttgggggtaaaagtttctcaagatgaaaaagttctgggggttagctgcacaacagtgtgaatatacttaacaatattgaactgtacacttacaatggataagatggggccgggtggctcacatctgtagtcccagtgctttgggaggccaaggtgggcagatatcttgggtccaggattcaagaccagcctggtcaatatggcaaaacaccatctctactaaaaaactacaaaaaattagccaggcattgtggtgcatgcctgtaatcctagctactcagaggctgagacacgagaattgcttaaacttgggagacagaggtgcagtgagctgagatcatgccactgcactccagcctgggcaagagagcgagattctgcctaaaaaaaaaaaaaaagttaagatggtaaactttatgttacgtgtattttaccacaatttttaaaaattgaattaagctgaatatactgaaatatactgaaaaatactgaatatactgaaaaggtacatcacatacctaagaaaaacaatccagagaagccataacaagacatattctagtaaaactattaaagaagaaaggataatgggaccacaaaatcataagagacttccagcactatttgttatgcttcaatcctttagagggaaacaactgtaccatgaagcacataagaaaagagttatatttttcatcataagaggtgcataaatgaggatttgttatattatcctctatactggtctatacacttgtaatatttgatcacacattcccacaaacgattcagggaacctactggctctgttaaattaaactaaatttgggctgaggaggtgcttgtgtaatgaactgcaacttaacttagtatgcaaactaatggaaagcctaactcaggaggatactttgggaacaaattgctgagtctcaggcaatcatagcagctgagctccagttaactgcaggcagcaggacaactgttccaatcctgttcatgtaagacgaacactgagccattaaccatcagctgtctctctacctcacttctgtttctgtacctcacttccctgctatccacaaatgcttttagaccacgttgcagccctggagttctctgaacctgtccctggttctgagggctgcctgattctagaatcacaaataaaaggcgattaaaatctgcaaaactagatttgttatacattttttttttttgagacggagtctcactctgtagcccaggctggagtgcagtggtgtgatatccactcactgcaagctctgcctcccaggttcacaccattctcctgccttagcctcccgagtagctgggactacaggcgcccaccaccacacctggctaatttttttgtatttttagtagagacggggtttcaccgtgttagctaggatggtctcaatctcctgacctcgtgatccgcccgcctcggcctcccaaagtgctgggattacaggcatgagccactgtgcccggcttcattcatcttttagcagtttccataattcaagagttcacagactagtgctgttgttggggcaaaacttgagccaggagctcaatatcacctagtcccaattcttcttcaccttctgctctgcccagttcatccctggactcctcacagaacccctcaggctctcctatgaccatgattaaatgtctatagcagtcccagcctaaatcctcataccagagtaagcaagggcattgcttctagaaactcccattcaggctcctggaactccctctctcaggctgactgaaattggctcctgaaacaatctctgtgtcaagacagtgagattcaatgattcagagtcagagtgagttggggtggagtcaatcctaagaatggaaaagggaaactgaggtgaatgaaggagaaatggattctgtgaggcacccacaacaaggacagcagagaccacagttctggtggctgtttcttaccctccagacactgtccctctgctgagctccttcaaaccctccagacatgatcagactcatctggacttactgtggggacatatctaggccccgactctgtcaaatatgtatagtgacttccatctaaaaggcacaaggttctttacagataggacaaccttgatagcactcatctgagaaagagaacaaattagaaataatcatccttcacttcctaacactcacacaaaaaaaaacaaacctaagggaaagcaagtgcatattaaaacagagttgatcaccaatgagcaagtcctaccaaagatggcagagaagctgaaaaggtcctctaggaactcactcaataaatgctcatttattccatttattgcaaagccaagaattgtaaataatttaactcacttaggaaaggatcttctccattattttatctgaatgttatctgatcttgatgttctgaagtctgacagttaccaaagcgagtaaaaatcctcatgttttccatgctaggaaaatcattaatagtttatccaaactgaaactttcttggcaactgttgcttccttgttcttgccataaattaactgtttttaaaaagctaaaatctaaagaatttccaggaccttaaaaccattagaatacaaagacactctaatttaaataaaattcataaccaaaagttaactcacctaaacacaatgtttccttgtgtcatttatcttctttgaagcccaatcaataacagattcattcattcactcacgcagcaaacatttagtaagtgctctaaatatacctgaagggacctcacacatcatctttcctgagctcttcctttacagattaggagattgaggtcaaagagagcaagtgatctgcccacagtcacacagcaaatatgagaatccatgggtgcaatcagatttcctcacctctggcctgacacgttatccaccctgccatgtttccttggctacagcaggccaatgatgcaatcggcctccagcagagaacactactgtagtaaatatcaatagctgtcaaatttatggccacacaacatggtttgaacacccttcctacaactggaagatctcccatatgagttccttctcctgaaatgtagaggcaaaagctcatccaatcctccctgcagctagagctcaggcatatggcttggctttgccaatcaggggagcagtgtgacgtagtgggcacaagcagggtaggcagcagtggcaaagcttctagtgtttgacctgcagggagctggcacttccatgctgagcgatggtcacagagctgtcttcacttgtcactgcccatcggtgagatttgggcactgatcctggctatatagaattctgtgaaactggctaaaatggactctggggtggggattgcatctaagaaccctgacctctgtgcttcattattacgtgctcaatacatatgcctggagctatatacaaaataaagggagcctctgctcaaaacttcactgtgcatcataagataccagttctcagctatctatctgagtcttaagactttttaaaaactaaatggttcttttctattaaaaaataagacaatgatgggactacttcacttttaacaatatatgctgaattatcaaatgcctatttaaaaaaaaaaaaaagatcaagaaggtggcagagcaaaccccagtattaaaatactccttcaccaaaatccaacagcaaagcaaagctggtcctcgtggctttttggaagcaagaagcaagggagaagcaagtaaacaaaaccctgaaccatttccctaacagctcccatcttaaagaataacagaagggaaagagctgaaggcagcctccagagaataagtagcattttccccaaaaccttcatgtcatctattttttccagagatggaaaaaatgctgtgactccctgctggaagaaaagcaagaaacccttccctgtggttacagatggtaaatgcttaaacgtgacaatgtcaaaggaacagtctcctaaattggacagcatggagtgggaaatggaaagacacataagggccttcctttcctctccccatcttgatgagcagtcctcaagatatggcctaaaattcataaacctagaaacagaggcggcctgagatttaaagtgaaaatgtagccaacaacaaaacaaaaaaactcgggagacagaaggggaaatgtgataattttttcatttttcatagcaagtgaacaatagatataatttaagagttgctaaatcaagaaacagaaggttatacataacaaatatacagagttatatgagtaaccactggaaaaactaaaagtagactctaaaccgtccaaagcaccagaagggaaacagtacacgcacacactcaaataacaaaaaggaaagcagggcaccagagtgtacacctgtagtcccagctattcgggaggccaaggtgggaggatcacttgagcccaggagttcaaggccagcctgggcaacataacaagaccccatctctaaaaataataataataacaaaaaacgaggaaaattggcaacagaaaaaaaccccacaaactagattataaagaattaggacttaaaacatctatgataacaatagatgcagatgagagaaattattattattattggaaaatgatatgttacacgtctacaaaacaagagaatccaatttttaaattattagaaagaattagaatagttagcaagttgactgtttgcagaattttaaagtacctttttcctataaacaagcaaaaccattgagaaaacagctgaaaagaccccactcacagtaactcctgaaaagaacggcacatctgaactagatgtgggcagaacctacatgaagaaaactggaaagttctccaatgaggcaaaaaggagaaattaaaagtagcaccatgtgcttggattggaatgtttcatactgtaaacttggccgggtgtggtggctcacgcctgtaatcccaacactttgggaggccaaggcgggcagatcgtttgaggccaggagttcaagaccagcctagccagcatggcgaaaccccgtctctactaaaaatacaaaaattagccacttatggtggcacatgcctgtaatcccagctgcttgggaggctgaggcatgaaaattgcttgaacccaggaggcagaggttgcagtgagctgagatcgcaccactgtactccagcctgggcaacagagcaagactctgtcaaaaacaaaaacaaaaacaaaaaaacctgtaaagttgttaattctccctaaatcaattcataaatttactgcaaaccaattaaaataccaggaggatttgggaacttactttggaactcagcaaaatgatactaatagtaatctgaaaaaaaatacacgagaattaccaggtgtggctgtttgtattttccacatgcttttctgcagtgtgacccttgtcttcctcccatcaagaggtagggcctatgtcccctccccttaaatgctggcaggtctgtgactgcttcagccaactgagtacagaggaaatggccccatgagacttgtgagcctaggctggaaaaagcaagcagtttccacctagtgttcttgggatactagctctgggggaagcagccatcatgtaggaagtccaactaccctgagaccacagtgctggaggagctacaagtatacacgtggctgaggccccagctgccagcaggccacaactgccagccatgtgagtgggacgtctgggatgtcccaccctgtcgagtcctcagatgagttacaaccccagctgatatccaacacaatcacatgagacctcaagcaagaatcacccagcagagccgttccaaattcctcaccaacaagattataaacaaaataaaacacctgttttaaactgctaagtttgaggataacttgtgatgttacaacagtaactggaattccatttaaaaggaaggaagggggccgtgcacggtggctcatgcctgtgatcccagcactttgggagaccgaggcgggcagatcacaaggtcaggagtttgagaccagcctgatcaacatgttgaaaccccgtctctactaaaaatacaaaagttagctgcgtgtggtggcgcgttgcctgtaatcccaggtactcaggaggctgaggcaagagaattgcttgaacccaggaggcagaaggttgcagtgagccgagatcacaccactgcactccagcctgggcgacagagcgagactccgtctcaaaaaaaaaaaaaaggaaggaaggaagtgaggaaggtaaggaaggaaggaaaggatggagggaggaagggagggagagagggaggaaaggagggaaggaaggaaagaaaggggagggaagggggaaggagagccgaaggggattggccctatcacatttaacaacataatgaatcaaaatccattcataaattcattgaacaaatattgaagatctacaggtccaccacaagctaggcattagagagacactgtgttgtgcaaaatctttgtctttatgggatttagattttagtgaaaaagaaatttcagatagtattaagtgtgctgaaggaaaataaaaatcaggataagagaaagtgctgcttaaaatagagtgctcagagaggcctcttggaggaggtggctgtggcgctgagccagggaagggcccgggtattctcacctactgctgtggggttttgcaaacggttcagcctgtccttggggcaatttgaaaaatctatttccatctaaaaggcatggacctcttgacctagaaacctcttggctaggaaattaccccatgaacattcttacacacgttagcaatacttccaagtatgttatgacaaaaatgagatacacaaaaatgtcagctcaatgggagcttattaaataaattacattatagtcattcaatagagcaccataagactttttaaaaattacatgagctatatccactgacaaacagctacatgagacactgttaggtgacaataagaaaggctggaactgtgtgcacagtatctcctcttctgactcacagagagagaaggaaccggggaagagggaaggatactcatctatgatctggaagaaatccccctttcctcggggaacacctctggggagaggagagagatttgggtttttcatttggtacctctccgtagcacctgaattttctaacaagatgctgtacaacttttacttttgtcctttcaatgcccgctagggttacctggaccatgagtcagtgtttgacagcttctccccaaagaaagaattggggctactagaccggacaaggttggttttctcttttggtactctgtatttccaaaaataactgaatggtatttttttaaataaaataatttgaaagaataaagccctataacaacaaagtattaaactgttaaaatattttcattctattgtaattataagaaagcctgcatggtcccactgcagcagccaccatgacgagcagcactctctgtaaatgcagcccttccacgctgctcagggtgacccaccccagtgagctggctatttgcatattcccagatcccccacctgcgccaggcaggcatatgctagatcagctcagaactagaaaagatgggcaccaggaagaaaggcaccaagccctccctaactcccctctgagagttgcatccttctttcctacctctttcctttttacagagcccactgtgctctgggtcccccatgacctgggggtcagagtcagacacactcctgtgcacaaatggaaccattcgttcttcaccaccacctgtgcccacacccctgtcaaagctcccccgcacccacctctgaatctcccgcatgggtaggacagcttcttcccgaagaaggggaattcctggccaggcacggtgctcacgcttgtaatcccaacactttgaaaggccaaggcaggtgggtcgcttgagcccaggagtttgagaccagtctgggcaacataacgagacctcctctctacaaaaattaaaattaaaaaattagccgggagtggtggcatgccagtagccccagctacttgggagactgaggtgggaggatcgtttgagcccatgaggttgaggctgcagtgagccgtgatcctgccactgcactccagcctgggctgtagagagagaccctgttggaaggatctctccgacagttatctcctggataactgcaatgggtcaagtgacaactttctctagctctcctaagccacagtgcagtacggtttggaaacagcaataagagtcaatcccccttttcacaaatgatcaaatgaggctcagagagattaaagaattaggcagtcattcttcacaaggaaggaagggagggagggaggaaaatttcttgtgaaattcccaaggaacagagaacatttttaaatgtttccttactcattagttaactcagtattttcatgcccaaaaaatgtcaacaaccagttttgccaagaataataaaaacagatactgactctgagcctttcttgcaagatctctcagggtacacacccggctgactcccgcacatttctgtctctcctgccttctcaaatctcgctgtctccatcagtgtctcttcttccatgcaaggctctgtcctctgaagttctctctcccctggcttcagccccatgcaggtgccccccccccgccccacatgtggattcagttccccacctgtggtccccatgattgttctactccaactccggctctcatcacccaccgccagtgtgactggggcacaatgtgactgggtgcaggatggggcagccacctcaggccccagagcgctccatcccatggccaaaggggtggatattccgccctgaaacacctgggagtgcataatgctcaaggtattccttcttcgaagctgataagtttgtctatgagcaaataatccactagttcctctgcaaggggactgcctgacttagaaagaacacagatgtaaaagattagtctttctcaaacactgccggtcatgtgtcagatatctagaacagcccctcaccagcaaacctggctggccccagccctgtctcaggcccttgtgttaatgctgggtctctggcccaggctcccctccctgcctgatgagttcccactgtgctttcaagggctctttcaggtgaagagacttagatcaataccaccttaggtgacccgaactttgactctccctcagggagcagcgacggggttttagtgtcttctctctgacagcccaaagcgcagatgccagctgctccacctcattcccagggacgagctccacagttgaggatcccagggagcagagcaggggttgagatgcaaacaattctgatcacaggcccctctctccaccctccccaaaagtgccacctgctgcatctacataattctgagagcccattcaagagaccgctgctggaaccaagaagctagttatctggatgatgtgggtccccatcggagacacgggaggggagaagtggtgggactgcttcatacccacacccacttcatgtttgccctagcaggcactgtgtagcactcatctggggccaaaaaggaataaatgacaacttgtttacagaaactgtgttgtaaaaatacctagtgggaccttgtttcaccacctggatctttagggaggtgcccgttctccccttcgagctcagcctgcccttaccaagttcctctgtttcccctcactgggaactctcaggaattgtcccccaacattattcccagaaacctgtgccaaccgctcatgcctatcttggagcatcacactatcagatacctggataactgcaatgggtaaagtgacaattttctctagctctcctaaaccacagtgcaatatggtttggaaacagcaataagtcaatcccccttttcacaaatgatcaaatgaggctcagagaggttaaggaattaggcagtcattcttcaatcattctacaaacttttcttcaacacccacctgtgccagcggatacctgcccctcataaaatactcccctccccagagatctgggggtggggtttcttgctcctggaaacaagggaaaaaggagagaaagaggtgtgagggcactcagagaggagcagcctgtcatcatgtgaacactgcccacgctgcctagcaggcctctgaagccaccccacgggagaatggctctgctgtttcccacgcctggggtctccctctcccactccagcatcctagcccaccaggtaggatgagtgatgctacatggacttccaaacatgcttaatctctgcagaccatggcacaggcccgaagctggcccgcagcacccaggctcagtacatgcccgccctcttcacgacctcccagaccagcccggccggtcacccatcttctgcacacatccctccccaacctcccctcaaacccttcacccaggtggggcttcccaggcaatctccaatctacggctgaccctgaaaaacccaggtttgaattgtataggtgcatttatacatggatttttttcagtcaaagttacaccaagtgtgccagcctctcctgactccctctgcagttgaaaatccacctcctccacctcttccttctctgccaccctgacacagcaaaactaagtcctcctcttcctcctcctcctcagcccactcagtgggaagacgacaaagatgaagatctttatgatgatccacctccacttaatgaatagtaaatacattttctcttccctatgattttcttaatgatattttctttcctccagcttactttatggtaagaatacagcatataacgcatatacaaaagatgtattaatcatctatttacatttccagtcaatatgaggctattagtagttacgttttggaggagtcaaaagttacacgtggattttcaactgcagagggagtcagtgcccctaaccgtgtactgttcaagggtcagctgtacaaaatgaggacaagacgtagtacccattccccagggtttactgctaggcttaaataagttgatatgaaacactgttagaatcgcgtctggcaaaaaaagtaagcactcattagttcttgtgatcgatccagttacagtttcacatacagatgactgtacccacccaccagcactcaccagagggggcccttggatctaaacagtgtggaagccacgcctgttcccctcacctcacacaggcctgtgtgcaaggtgactgagcccccctggatttctgactaatcatctttggaccaccagcaggtaaacaactctcccctcctgtgtccccagaatgcctcagcagcattagtttcctattgctgctgtaacaaattgccacaaacctggtgacttatagcaacacacagctatcatcctacattctggaggtcagaggtgcaaatcagtctcactgggctaaattcaaggggtcacaagcctcgatcctcctgggggctccaggagagaatctgcttccctgcctttccgggcttccagaggccacctgccttcattggctcataactctcttcctcacatcattccagtcactgcgttcatcatcccacctcctactactgactcagatcttctgtctccctctcaggaggacccctgtgattacacagggcctgcctacataatccaggatagtctccctctctcaagatccttaaccgaatcacatccgcaaagtccctttttgccatgtgagacacagattcacagcttctagggattaggatgtggacttctctgggggaccacagttccatctaccacattgacctaacccatattcaacctacccagctttgctagctcttagacgttgggttagtcccaatacctggtccacaaaactggaactgaatatgacatttcacatttgcatcataaagattctccggatgctgtgtgaaggggaaattgagaggacaagagcagaagtggagaagccacttacggggctaccagaataatctgggtaagagagacacagcaggcagaagtctgtatttttgaagaagaatcagtaggatgacaagaggctacgttaggaaggaccactggtgtctggttggaggaactgggtgaatggtggttccactccttgaaaacagagcagaagacacttatttggaggggaaatgagcaacttggttggggatatcctgaattttaagtgtctatgacttgtccaagtgcagatgtaaagtcagcaatagggtatgtcaagaggagagaggtaacagcttcaaatgcagagacctgtgtgagtgacagaagtgtccagtggggcagagagagagaagcctgggcccaggaatgtcctcctgctgaccagctgcagtgaagctccgctggccccatctctcagtgtcagccctgcccttgctgtgtccactgccagggtgtcccttgcaggggcactcactgcacagtcatcattcccagggagcatggccacttcaccttgctgctccgccacacctctgttttgggcggccctgaggatgctctgagactgggctacagtctccacaggttccagctatggatgtctgccccacagcctcatctagggaggtctgtttgcccaccattgagggccctgtggcagcacctggctcttccctctctgctatgttcaacatgtcccacagcaacatggaaattagcaaatgtctttattccacacactgtccatgggaaatttcagacccaatcttgtagaccagaggtcaacaaactatgatccctaggccaaatctggcctgctgcttttgcaaacaaagttatactggaacacagttatacccattcatttataaatggtctatggttgcctccacacaatgatggcagggttgagtagttgccacatcactaatcatcagggaaatgcaagtctaaaccacaatgagatatcatctcacacctgttacaatggctattctcacaatgacaaaagacagcaagtgttggcaaagatacggagaaaggggaacaatttctctgctggtgggaaggtaagttagtacagccattacggaaaacagcatgaaagctcctttaaaacttaaaaatagaactatcccatgtagcaattccacctttgggtatatatccaaaggaaatgaaaccagtatgaatgaagaaatatctgcacccccatgttctaaaatgaattcataaatccatacatatatacatacatacataggagagaatggaaaagctcttcctacagtagaataacaattaataaatgtagaaggaatgggccgggtgtggtggctcacgcctgtaatccccgcactttgggaggctgaggcaggccgatcacgaggtcaggagatcgagaccatcttggctaacacggtgaaaccccatctctactaaaaatacaaaagaattagccaggcatggtggcgggtgcctatagtcccagctactcgggaggctgaggcaggagaatggcgtgaacccagcaggcagagcttgcagtgagccgagactacgccactgcgctccagcctgggcaacagagcgagactccatctcaaaattataataataataataataaaataaataaataaataaatgtacaaggaacggaaatataaaattatgacttggcaatcatcgtagaggaggctggtttgggtggcaatcatcaacggatgtgaagttgaaagagagaggtttgaccagaaacaggatattggcataatctgagacttccttacacaaattataattaaaggggaaatggtgaatttaaaatgataacacctggaggacagcaataatgttaggtgatcaaggtgaatatcgccaatggtgagaagggctgacatcaacgcctcctgatgcgatgcactgagaaaagcatggcatcaactttgggattgtcctgccaagaatgcatgagccaagtctgcccatgaggataatcagatggatccaggttcagggtcatcctacagaatgcaaggcctgtgcccttcaaaactgtggaaaacgtgaaacagagaggaaggctgaggagagtgaagacacacaaggaatgctcatgttcctgggtaggaccctgggccagagaggaaaaagaaacactacttggtcaggtgatgaaattggaatggggtctacagattggataacaatgttcttccaatgttgttttcctaatttggagaggtttatgatgagtacataaagagcatccatgagtggtgagaatatacactgagttttttaggggtgaagcaacatcatgtccacagctttctcccaaaacactgagaaaaagactaatgataattgagaatttttttaccttgagaaagacaatgtgcacaagctcaagccatggggtaaatgcaataacatgtttacaattcgggaatttaagagaagagacacaggaattcttggttctgttctgtaacttttctataagttagaaattatttcaaaaaatttccagaaaacaatattaagacagagtttcattgtttattagcatagaatttggctatgagcattccagtgtactatatcttcaaatgactaggactttttacccgatgcccaagggagggttctgtctatgtgtgtgtgttgttgttggttttttttggtgtttttgttttgtatttgtttttgtttttgtttttgagataggatttctcgctgtcacccagactggagtgcagtggtgcaatcgaagctcactgtggcctcaacctcccagactcaggtgatcctcccacctcagcctcccaagtaggtggaactacagctgtgtgccaccatgcccagctaattttttgtattttcagtagaaacagggttttgccacgttgtccaggctggtcttcaactcctggctcatgtgatccacctgcgtcagcctcccaaagtgctgagattacaggtgtgagccaccacgccctgtcaagtttttctccttatctttaaaatccattattttacagggaaacatgtcaatgctgactattctacattgatttttcccagttacacaatgtaacctttcaaatcttattttaggaaggttttcttgcattatagttctaaatatttatgctattctattgctttgtttttctgtccctggacactaattatacatatattgaacctcctttgcctgtgtcctacattcctttaattcactatatcaccttcttttttttattatttttctccttttcaccctctatttttatttctgtgcttcctaagaatatctatttgctcccatgttccttctaattaagtcttcatttttgaaactcatttttccaaattcttttctgacatctctctgttctcctttcataatttcctgtcatctagccatatcttttgtagtttttacaatttctgattcaggatgggagcagtggctcgtgcctataatcccagcactttgggaggccaaggctggtggaccacctgaggtcagcagttgaagatcggcctgctaacatggcaaaaccacgtctctactaaaaatacaaaaattagctgggtgtggtggaaagcacctgtaatcccagctactcaggaggctgaggctgaggcaggagaatcgcttgaacccgggaggctgaggatgtagtgagccaagattgcttcattgcactccagcctgagcaacacagcgagactctgcctcaaaaataaaaataaataaataaataaataagtaaaataaagtttctgattcatactactcttaggaaactttattttcttttagcttatattgaaatattaatttataatttttctggtgtgctctcattttcagtagtaccattatgttcattttcatcatgttttcactgaataaatgttgcatgaggctggatcgtattccttttttgttgtccatgattaaatgaggtggattttcctgatctattaggaggaagttcccaatagatcaggaaagttcctaataaagggatggactaggatacctttcccatttggctctactgatctgtgaaagactcaaaataggaattctccaggtacccacttgtttcccagcatcaagtccagaacctttgtaaagctcagaaagatctcttgcctctagtcctttgctccagctctagaactttgaagtccttcttttccaaggctatatgctctcagcttttgatgttatctttcactgttaaagcagtttttgagatctttttccttgggggtccccttccatatctccaccatctgaacctattttctctcgccatctgtcttctgcttaacttggtgtatgtttccagtaatttctgctcaaggtgaggtgcttagaagggaggacttactgtacgtttctaagattctccaaggcctctgccaccacatcgacgctgattctcccaggtccacacacagttagttgctctcacctgttgccagaagcctgggagcccctttccagttttgccagttgctctcaggtctgcccaccagacttccatcctactttaaagggtgagcagctcatggtagtttttgggttccaccacctgtcaatagtttctttcatttcccatcactcccctgaggccactgcggctcttctccaggtccttctgatgctggtggtttggccaaacccacccagtcctgggaataaaggagtggggagagagtccccaacacttttgttgacatatcctctttgagctttatctatggctgtcttgctgattggtttagcttccaggaagagttcaggggagactgaaaaactactttgccaccatgaatacatccccataaaacatgttctgaagggcataaaacaaggaacaaagaaatgaagagacatactctgtttctgaattggaagatttaatatgataaaactgtcagtactcccaaaattgatgcactatattaaaagttttaaagttttctatctggcaagacatcaaaaattaagcaaaatgagaaaatatttgcaacacataataaagtatccatggaaattcagatccaatgaaatatctttctgcttctatgaaattaataaaaatgctcagccttgctaatatcccacgctgcaagaggacagaaaaaggggcacacactgtaggcttctgtgggtggatgtgcctacattcttttgtgaaaattaatccagaaatagctaacaaaactcccaatttgaatactcatcagctagcaattccactttggggaatctatcctcaaaaaaaaaaaaagcagtggcatctcaggctggataagcagcactgtttgtagacacatagaactggtagagattattcccagcaggagaataactgaataacttgtaataattcatactttggactactccacagccattaaagataatgtgttaaaaaataataataatgagttatggctgggaatattcgttatacattaaatttttaaaagaagttacagagtaatatgggtggtataatgtcatttttgtaaattgtttttaaaaagaaaagaaacattttccggccgggtgcggtggctcacgcctgtaatctcagcactttgggaggctgaggcaggcggatcacgaggtcaggagatagagaccatcctggctaacacggggaaaccccatctctactaaaaatacaaaattagcagggtgtggtggcgggcgcctgtagtcccagctactcgggaggctgaggcaggagaatggcatgaacccgggaggcggagtttgcagtgagccgagatcacgccactgcactccagcctgggcgatagagcaaggctctgtctcaaaaaaaaaaagaaagaaaagaaacattttccatacatatatatacaaattctaatacattttatgattgtaaagggaagcatggaaggattgcattaaacaacactggtaatgttggtggtctatgggtagagaattggggtaggcgaaagctatacattgtttgtgtgtatgtgtgtgtatatatattttttgtttgtttgtttgtttgttttctgagacagagtcttactccatcgcccaggctggagtgcagtggcgcgatctcactcactgcaagctccgcctcctgggttcacgccattctcctgcctcagcctccagagcagctggaactacaggcacctgccaccacgcccagctagttttttgtattgttttttttagtagagacaggattccaccatgttggccaggatggtctcgatctcctgacctcgtgatccacctgcctcggcctcccaaagtgatgggattacaggcgtgacccaccgcacccaacctattttttttgagatggagtttcactcttgtcccccaggctggagtgcagtggagtgatcttggctcactgcaacctccgcctcctgggctcaagcaattctcctgcctcagcctcccaagtacctgggattacaggtgcccaccatcacacctgactattttttgtatttttagtagagacagggtttcgccatgtgggccaggctggtctccaactcctgacttccagtggtccgcccgcctcagtctcccaaagtgttgggattacaggcatgagccaaccatgcccagtcacttttttatcttcagttatttttactttttatatattaatttcagagtatgaaaaaaatccagtggagttgctttttaaaggaaaaatacacacacacacacacacacacacacacacagagtcagcttccaatggctacgtctttaccaacatatgtaactggtaatgtggataactcacaatgtagctgtttgtccctgagttctgggcattaataaaatctccaagaaaaataacaaactactctattaaaggataactattcaagacctccatccagctctcttagtcttctaaactatgaacacagctcattacctctcaaaatgggcaggacatctatccacaagggaactgatccacctgctgactcactggctggcacagcccggcacaggaaaaccacctgcagggggtcctcaaacaatggaaactgcacagctctgtattcatcacagacctccggccaggcctgacacccacccctgtctccaaccttgccgagtcctcccctttcaaccttaaacttcttcaacttggtccagtggaatggctccttaaatttctcttgtatcttcacctttccaggcatgttttatgcttttcctaagaaagagagagcctccttgctaaagtggacccctttaccagcatgctttatttcatccccttctgcctaatcgttagcaggagtttggcctctaaaaagtcagagcaactaagttcaaagctacttcatagctgagtgaccttgggtaagtcactcatccctcttccccttagtttactcagcagaagcaccaagatttcttgaggctttggcttggaacagagtcaggctcagttctgctgtgttccaatggctaaggcaaatcagaggcccagtccaaactcagggagagggaaccacacaaaaccctgagcaccagcaggcagaggccaccagagtaacaggctattacacacacaataagtaagtgctcactaagcatgggctgtctgtcttagctaataattttgtttcttaaatccaggagagttgtttctacaatgggttttcaccatgtgcaaaccacagagagggcctagaaagccatatgttgctaaagagcacataggtctcattttagaagatttagagaaaccagagggcagccctaagccccacagtatggatttctttatgaagccagcccagccatcccagctgccattcttaaatgacgaacaaccttggcaaggcagttgcaccaatctcagagggcaggcatatatatggcaatgggtcagtgttccccactcacaaccatgttaacatgcaaacctgtctcaacacagcaggaaccaatcatcatttctgcaaagtgttgtagacaacagatgaaaaatggtatacactgtaccgtactgaaagaactttcaaggtgcttgcagcaaagtaagtttgaagacagaaaataagcccatgaaaaaacagacaggagggtgggagatggaggactcaggacagaagtcatcttataatctccaaaatgtaagcagagtgtgctgtgttcattgttgatccccagaccctagagtaatgtccatacataggagaactgtgtggaattgctcagaatcataggaagctagaactaacaggttataggtcgggcacagtggctcaagcttgtaatctcagtgctttgggaggctgaggcaggagcatcccttgagataaggagtttgagtttgaatccagcctgggcaacataacgagaccccatctcttaaaaaaaaaatgtttttagtattagccaggcatggtggtacacacctgtagtcctagctacttgcaaggcagaggcaggaggatcgcttcagcccagcagttccaggctgccgtgagctatgatagtgtcactgcactccagcctgggcaaaagagcgagatcctgcctcttaaggcaaaaaaaaaaaaaaaaaaaaaaaaagaataggttagagctgttgaagagaataacactgcaaaagcaaactgaattaactgttttacacatttatttaactctttaaactaaaatgtaggggatgatgtgcatttttcacataaataagcttttctactgtgtccaattaatgttttcccctttaggtttattattaaaaggcagttctctctccacacccttgggaacccaaggctaaaccaggaagggcgggctcagggaggagccaggaagtggagctaattcaccagtctgccacctgtaggctggttccagcagacttaaacctcagtgcccgctagacagacatgaaaacaatgcatattaaataatggtaaaaactgagcaatagatgtgtgaaaactatatagagaggggcatttaaatcatggctcccgtgtgcttgcctccaacctcctctcttttctttgaatactcccagctatgaccacacagtctgttgttcctattcagctctccaaggctcacccttgatctaaaatacgcttcgaaaattaatactcccattaggatgaacaaccacacctgtatcgatcgaggtgttccagaggcaattttgctcagatcttatggtaaaagccatgcaatgaacttaaaaaacaaagaccattatgaaataaacaaataagcaaagctggacgaatttttcaaattttaaaactcaagaacaaatagcaaacattagttttaaaggattggtttggatttctgtagatggaagtaaaacatactgagtttacaagcctatgcgatgtatttcagcacgatccaccaaatgcagttacagatgtcaagagttctcagaacaagtgcctctcttcataaatatctgctctgcatatatatctctcccattcccataacgtccattctttgttaatataggaaaaaaaccgactttcatcaaaatgctacaaaacgccaaaaattaactcttggggacagtcactttaatcgagacgtctttcttctatggagatttgttcaccactggcttctctgatttggtggttaagagtctgaaaatcggtcatccttaaggtctggagctcagaaagcacgccgcccccccttgcctgccccctgccccaggacgccggatgcgggtcgcctgcccagtcccgtcgcccacaaaccacgccgttctgggcggacgcgggaaaccagaagtccccgaagccaagtcagcgagcgaccacaggggccgcccggccgatccccgatatccgggctgacccaaaacccgacgggaggcgcccctcccccgcccccccaccccaccccccacccccaccgcccccggtcagggccgccgcgagggtgagaggcgcgcccacatgctgctccgctccgggttcggctcccacctcctcgcctcggccgcggccgctcggatggcgaggtcgtgtccccggcgcgcgcggtccccggcgctccctccggccgctgcgggctcggaggacggcgggcgcctggctgctgtttcctccaagaaaagtaactccgggaatcagcgcaataggagcgggaacgcgatgctccgagagcggcgagccgggccctggagttattctgctcggagtttcgaactgcgccccgcgctgcagctactcggccccggcgttggccgccggaacttgccgcccgcggtggcgtcccggcggccgcagcgcctagcccccccggcccgcgcagtccccggagcccgtccccgcctggtcgcggacactcaccgagaagcctgcccagaaggggcaggagtggcggacgcgggccgaggtggtgagcgccagcgcggcgaagctgactgccacgatgaggcatccgagcgccatctgcgtggccccgagcgccagcacgatgcgggagcggcccgggcactcgcgcaggcgggacaggctgcggggcagcgcggcgggacgcggcgctcgggggccgccggccggaggcatcgcgccgggcgcccgcacgcctcgcccgctcccgcccggcccggcgcgcgccgccgcctctcctcacagagggtccgaggcaagttgcgccgggtgcagggacggcctcccagccggctgccagggctgcggcggccgcgcgccgggagcgggccgggccgggcggggagccgggcgcccgcagcccccgccggtgcccgcgcccatgccgccgccgccgcgccgcccgcccgccggccgcgccgcgctgcgccctcccccgcccgccccgcgcgctccccggcccgagcgcgggcgcgagccgccgccgctgctgccgtaccgggcgcgagccgctgccgtccccgggcgcgagccccgccgccgtgcgctgggccccagctggggcgggagcgggagccgggacccgggagccgggagaggggcggggaaggcgcaggtgcggtcctggcgtcccagcctccgcgctcacgcctcgcgccctggcggctgcaggtctgcggaaggagagcgggggcggcagcgcatcaagggcaacggcatcagcctccgcggcggagccctgggtcggctgcgcggaggggcccgatagcggcagcgggccagccgagccttcagagcctggggacggctcgggatgggcgcgcggggcgctgaggacggggagacgggctgggagcagacaggagggaaattccgagcgctgggccgcaggtgtggcgaacaggagcctcttgaatgcaaaaatccaagatccaagatgctgcttttctgcagttcgagaatctcccaagccatccgctgagagaactcagctctggaggacattccgagaacattgccaggacacacacgatgtcccttacccacctttggtttgcatgcttttgatacaagttaaaagtttgggctttaaaaaaaaattgcacaaaacgaatttaaatgcgcaatatcattaataaccgattaaaccatctccactccctcttgccaacatagagtttaaaatatctaagtactggctcccttggaataccgggaaatcctgcaagttttgattgccataattcctttgtggccctgttgatgagccaactttaagactctgcttgtgttgaaaagggctgcattgacagattaagagatcaccagcgttagggagtctgaagggaccagacgtgaaaaggcaaagttcagagtaataaagggaaacggccggtcatttcctgagaccattcttccgtgtctttctagcagaccttactgttggatgagaaacgctagagagtgtagtcccaaaatatctcggttgctggtgcttgaaatttcaccgttagagatattgattcctttggggcttgacgatcctctattaaaatgcaaattccccttgaaggggctatagctcaagcctttatcagccaacactttagcagggatgggatttattttccaatttaacgagatggccaagggatgaacagggggtagggaattccacagatagagtgactgatctcaaaatgctggcccgtggccaaacgctgccttctcccccagttcttatctttaacaggactaagcctctggccggcattgtttaaagcactccagtacaaattccaatttcctggagacattttctgcctagaagttcgcagtgcagcactttttaagagcttgaaacaatacaaggcatgaccctggactggcaggaagttatgttcgcatttgatcatctcccccattcattcattcattcattcatccgttcattcattcctccaacaaaagttcataaagagctctctaatcataaggctttttttttttttacgttcttagggtacatcagtgaacaaaacagacaaaaatccctgcctttaagggattcagagagaaacacacaatagcctaacaaattagtgaattacagtttattgacattgtatactattcaaaaaatagtatacacccactatgtgccaggcactgaagatcgaagaatgagttgcaagccccctgtactcagagaactttcggtctagtgggaagactggcggcacactgggttcagtgttatggagactacacagtgcccccccaaccccacccccaccaaaaaaaaggaatcagatgataaggagatttgaaaagagttttctgaccacaataccaaaaatgggttgaggggtgcccaagtgaaagagtgttcagaggctgttactgtcagctggcaagaggtgatagtgttttggattaaagtggggttagtggagatgtcgagaattgggtgtgtttgggagatgtttcggaggtgtcagtgatgaattaaacagaagggggagccagttggtgacctccagtgatctcccatttatgaatgagagatgcttccaaaatatatgtgaattgatttgttttatttatttatttaagaaaggtacggaaagagagctccaagcaatacagcaggagattttggtgaaggtgggttaggagagggatctactttcgctgtaaaatttcgtttgcatccaaagggagagactgatctagaaattaaacttacttcacatttctatcaatgaaaaagcagttttgttgataaaatgaaaactttagacaaataaatttaacagagtttacttaaacaatgaacaattcatgaataaggcagccctcagaatcataagaggttcagagaactccactctgccatgtgggcagtgagtatgtatagacagaaaaagattgaagaaagtagaaatgaggaacaaaaagcagattagttgtttcaaagttactttccccataatggttaaaacggaacttccttatcatgtctgctcaaactggcctttctggatatttgtctattctctctcttctttctctctctctcttctctctctctccccccctctctctctccctctctctctctctctttctctctgtgtctgtctttcccccacccctcttcctctccttctcctgatttctcataaagtcagctaaacaaccgagtttcagcttggtggattaggactttagcatgactgactccattttaatttggtctgttggtgggagctctgtccaaatcaatggcctccaaaaatttttatttcatactatgttttacagaattttttaatcctgttgtattaaatgcaacagccaaagttaccttgatgaacacttgcaatttggagatataaatagggagataaaagtagttaaagtgagttgatttcatgggagtgaatcataaagaaagaaaggaaagaagaatgaaagggaagggaggaaaagaacagaaagaagggaaggagaaaggtagggagagagggtgctggcctgagcttagcctccctggcactgatcacgacaactcattgactctctttgatcttcagtgtttgtctcttgtaaaagcattataatcatacatgtcctagtgttacagaagattcttggagacccctggaaccaagttatggcttttattctccctggatcagatgggactaatagacaaaaccattgttcttttgggttttgtttctttgtttttgtttttttaaagacagagtctcagtctgtcatcaggctggagtgcagtggcatgatctcagctcactgcaacctccacctcctgagttcaagcgattctcgtgcctcagcctcctgagtagctgggactacaggcgcacgcccccatgcccagctcatttttgtatttttagtagagacaaggtttcaccatgttggccaggatggtctagatcgcttgactttgtgatccacccaccttggcctcccgaagtactgggaattacagatgtgagccaccacacccggccaagaccattgttcttaagcaaagcatgacaaggtggctgagcttcttgctgaaagacaggtttcagggctgcttgcaccatggggagacaaggaacacttacaaatgcctcagtcaccacatgcttgtttcagattcctgctctttttgacctgtacctgtccatacataatggatgagaaagaatctagacccttggtagcctctcttacgcagtagagagttgtgcttggatctcacaatttctgcctatggaagagtaataggggagaaactctacttctaggaatgtcagaccagctacttctcctactaaagacaacttagaaaccagggggactttttttaagtatctccttaaaagtatcaaagattatggagataatgagggaacaccaagcctagatgcaataggagaaggaatgcggagaggtgtgtgcagcacgtgggctgcctttctagctctggcagctgcacacagaatcagaaagatgaatttgagttcaggagtctccaaaggtggggacccagtaaaccagtcccctgccttgtgacagaaccccaaatggctgcatccctggagcaggaaataagtcaaacttccctctttttgcaggtgcccagaaaccccaattctgcattgcacaagcccctaggagctggcaaaacaatagaaaattctctctaaagaaagatattatcattctaggcctccaattatttctatgaatagaatttttaaaactcactttcccttaacttcctcaacacgataaaggacatttatgaaagacccaccactaacatcataatcaatggtgagagactgaaagcttcttcccaagatcaggaatttgacatgtggtgaatgtccacattcaccaccactgttcaatattttattggaagttcagccagaacaattagacaagaaaaggaaataaaggacatccaaattgtaaaggaagaagcaaaactatctctatttgcaggtgacatgatttgatatatagaaaatctcaaagaattcacaagaaagctactagaactaataaacaaattcagcaaagttaccaggtacaagatcaacacatagaagttagttgtgtttctatacaccaataatgaataatctgaaaaggaaaacaataagacaattataataatatctaaaagaatgaaatacctgggaataaatttaaccaaggaagtgaaggcttgtacactgaaaacattgctcaaataaattaaatacctaaataaatgaaaagacttgctatgttcatgcatagaaagacaatattaagatgacaacaccccaaattctctacagattcaaagcaatccctatcaaaactccaacagccctttttgcagaaatggaaaagccaatcttcaaaatcatatggaattccaagggtccccagatagccaaagggtcttgaaaaagaacaaagttgaaagactcatacttctagatttcaaaacttaccacaaaggtatagtaatctaaacagcatggtactggcataagagtagacatctagaccattggaatataattgagggtccataaataaatccatacatctaaggacaactgatctttaacaagggtgccaagttcattcaatgggagaaagaatagtctcttcaacagatggtgctgggacaactggacttgtacttacaaaagaaagaagttggactccaagctcatatcataatcaaaagttaactcaaaatggacctaaataaaagagcaaaaactatggaagtcttagaagaaaacataggcataaaccgtgaccttggctctggctgtagattcttagatatgacaagagaagtatgagcaatgaaagaaaaaataaacaaattatacttcatcaaagttaaacacttttgtacatcaaagcacattgtcaagaaagtgaaaagacaaactataacatggaaagaaatatatgcaaagcatttatcttgaccagagatatatgccatgtattcagattatggatagaactactcaaaacaaaatgacaacccaatttaaaagtgggaaaatgacttgaatagacatttctcctaagaagataaacgagtgtcctgtgaacacctgaaaagatgctcatcactcatcattggggaaatgcaaattaaaaccataatgtgatgccacttcacacccatcaggatagctatattattaacttgtttttgtttttgtttttgagacggagtctcgctctgtcacccaggctggagtgcagtggcgtgatctcggctcactgcaagctccgcctcccaggttcacaccattctcctgcctcagcctcccgagtagctgggactacaggcgcccgccaccgcacccgctaatttttttgtatttttaatggagatggggtttcaccgtgttagccaggatggtctcgatctcctgacctcatgatctgcccacctcagcctcccaaagtgctgggattacaggtgtgagccaccagacctggccagctatattatttaaaaaaaaaaagaaagaaagaaaggagcaagtgttggtcaagatatggagaaattagaacccttgtgcatttctggtgggaatgtaaaatggtgcagccactgtggaaaatggcatggtgacccctcaaaaaaatcaaacaaattctacttctggataaatacccaaatgaattgaaagcagggactcaaagaggtgtgtgtgtgtgtgtgtgtgtgtgtgtgtgtgtgtgagagagagaaagggaacacgtgtgatagggtgttactctgtcacccaggctggagtgcagtggcacaaagacggctcattgcagcctggacctcccagactcaggcaatcctctcacctcagcctctcaggtagcttggactacaggtgcgcaccaccgtgcctgactaatttttgtattttttgtagagatggggttttgccgtgttgccccagttggtctcaaactcctgagctcaagcaatccacctgtcttggcctcctgaagtgctgggattacaggcataatacccatgttcatagcatcattattccaaaggtggaagcaaaccaagtgtccatccttggatgaatggataaacaaaatgtggtctgtacatacattggaatcttattcagcctttataaggaaggaaattttgacacatgctacaacatgaacaaaccatgaacattaggctaagtgaaataaggcagtcacaaaaggataaatattgttcagatccaccttatgaagtacctagagtagtcaaattcataatgacagaaagcagggtggtagttgctaggggcagaggggtggtgggaatggggagttagtgtttggtgggtacagtttcaattgcagaagatgaagagttcctggagatggttggtggtgctacttgcacaactatgggaatgtgcttaatgccacagaattgcacacttaaatttgttaaaatggtaaattttatattatgtatattttaccacaataagaaaaaaacaatgaaattctcaaatccacgaggatggctataataaaaaaaatgaaaataacaagtgttggagaggatgtggagaaattgaaacacttgtaggttgctggaatgaacgtaaaatgctgcagccaacgtggaaaacagtctggctgttcctcaaaaataaacgtagtatttccacatgacccagtagttccactcctaggtatatacccaaaggaagtgaaagcagtgactggaaaagatatgtgtgcaccagtgtcctggagcatgtttgttcaggtgattatcattggagggctggaagcaagctggactccctggacactgatggagaatcaggcacatatagaattttgacttgtctttgttcgttaggtttaaaatgtctgtctcattgctaccaaaataattaaaggtcaactaagtgcagggagagaagaaatctaatttgacaggccttgaaatacttattacttcataggttttgtgatgagatttaagttagatcatgaatacagaaaagtattttttcaaacattacgcactttatgaatgctggccttattccgttagcagtaagttccttacggacaggaatcattcacgtttgcagtatcctaatgcacttagcacagtcctagcagatagtggtattcaattactatttattcaagctaattctgtatcttaaactatgttaaaattgaagtttttaacacttctgggatagtattgactagaattttgtgaaaaacccctgagaagtaaatgacttaattattgaaggagggtaataaggctaagaagtgagttccagttaactcaactagcactattaaatcaggttattagaaacctatgcattctaatggtttcattagaataagcagttattcatatgctcagactcaaacaaacttatacatgaaagaggtgttttgcctttagggaaaaactatgaaaattatgagtcaagcctcatgagatttgataattctcatccatcaactgaacagaaaataatggagtaaaatttatcatttggctctaaagtatgggtcaccttcaatcagaactccttcacttttattttattaagaagcaaaagtaaaacactttgcttgtggataaatggaaagttgcttagagaaataagcattaggatgcactcatttttggtgtcgattatgtgattggcccacatttttatagcaacagcaagagcagcagcagcaaattgctgagacgtaattcttatggcatatgttggcttttttcatgcaagcaagctatatgttcagtggtaacctggaccattcagcaaaatccatttctctcttcactctctccaacatgtttctctaatcctctgctccagcaaaatactggcctttggtttctttctttttttttttttttttgagatggagtctcgctctgtccctcaggctggagtgcagtggcgcgatctcagctcactgccatctccacctcctggattcaagtgattctcctgcctcagcctccagagtagctgggactacacgcacctgccaccacacccagctaattttttttttttttttttttttttttttttttttttttttttgagacggagtctcactctgtcgcccaggctggagtgcagtggcgcgatctcggctcactgcaaggtccacgttccgggttcacgccattctcctgcctcagcctcccgagtagctgggcctacagatgtccgccaccacacctggctaattttttgtatttttagtacagacagagtttcaccgtgttagccaggatggtctcaatctcctgacctcaagatccacctgtctcggcctcccaaagtgctgggattacaggtgtgagccaccgcgcccggccaattttttctatttttaggagagacagggtttttccatgttgccaaggctggtctctaaactcctgagctcaggcagtcggcccatctcagcctcccaaaatgcggggattaaaggcatgagtcaccacgcctagcctggcctttggtttctaagcttctggacagtaatgggtcactcctgctgagaatgactttcttcatcacctttgcaaattctatccctctcttaggtcttctctcacatctaaaagtcagggcagcagaatggttagggcacccatgttagtgtcacactgccttagtaaaaaccccaactccacttcctaatgaaggtaataataatacctatcttataaatttcttgtgaggattaaatgatttcatttatctagagttcttagagcagtacctggcatatagcaaacactaagtgccagttatttttctattattgtgtcagtacttctatttgaacatattcccgttaggtctagctttccctggcctatagcggcagaacagattatgctggaaaagaccaaagggaaagttaggcctacagggtctgcatccagaagatgaagttatattagaacctcaaatgcaagactgaaccaaaataggaggaaaggtgagatctaacaccattggtagactaagagcagaatacagatattcagcaaaggtggcttggtacctggcacccatcttctaagtcagcataaggcaaagaggttaggctgtttcctcaaatatggtataataactgagaagagacttcacaatgggtatttatttgaatttcccacagtgtacagaataacaccttattagaataaaagctatagtaaatatttgtatattgatgtcttaaaattaagaaagtatttaaaatgctcccccttttaagccatctattctataaatatctattgagtgaaataatatacaagacattaccctaagccatgtaaagatcagtaagacctcgcaccagacctcatatttcttatgggctaattactacctataattcaatagtcattattgtaatgactttattagttttagtcttctaattatatcattatttcaatatctttagaataaacagaccaagtaatgaaatttcagaaatgatttagtgatgtaagtgtgggatctaaacaaaaacaactttctaggaggtttcagatttgattataatcatctcctaacatggaaaggatgtagaaatcctttttctactcttttcttgtagggattaagtatcgttgattcttaagaaggatattgaaaaaaggcaataagaaatacaataacatccctatagacagtgagagcataccagaaagacataaccacaaaatagatcaactgattagatgagtgagggccacccacattatggaggggaatctacttcacttaaattccactgggttaaatttccatctcatccataaacaccttcacagaaatacccaaaataatatttggccaaatatctgggtactgtggcccagcaaagttgacacaaaattaatcaccacaatgatgaaatttttaaaaaactcctaaacaaatggagaggcatagtgtattcatgaattgcaagagtcaacatagtaaagatgtaaattctccccaaatttcctgataggtttactgcaattcctatcaaaatcccagcaagttggttttttttttaaaagacatatgtacatttatttttaaatgtatgcaaaaaggcacaggctctagaatagctaaaataatccgggaaaagaattaagtgggagtaattacttgatattaaggcttactacagagatagagtaatcaatatattgtggtgttggcagaaggatagacacacagttcaatgtaactgaatagagaacccagaaatagatccccaaaatatgctggttttttttttttttttttagatagaggcttgctctgttgcccaagctggagtgcagtggcatggtctcagctcactgcaacctctgcctcccaggttcaagagattctcatgcttcagcctcccaagtagctgggattataggcgtgcaccaccatgcccggctaatttttttgtatttttagtagagatgggtttcaccatcttggccaggctggctaattgatttctgacaaaggtgcaaaagcaattcaatacaggaagaaaataactgtttcaacaaatggtattggagcaaatggacatctgtaagcaaaaacaaataaataacaacttctatttaaacctcacactttatacaacaatgtattcaaaatgaatcatggacggacttacatgtaaaacagaaatgaaaggaaaaaagaatttcagaaataaagactaaacaaaaagcagtacaagagtgaataaacacaataaataaaaacctgaggagcaataaaaagcaaaaaggaggaaaatttttaagatcataaagaaattaaaaagataaaaaagattttagatagtggcatatttgaagagtgttaaagaagatccaacatgtggctgaaaggagtttctgaaaagggaaaccaaagcaagggaacaaaacaaatattaagaactgtctctcaagaaaataatcctgaatttattttattttattttattttattatttttttttgagatgaagtctcactgtgttgctcagcctggagtgcagtggcacaatcttggctcactgcaacctctgcctcccaggttcaagcgattctcctgcctcagcctcctgagtagctgggattacaggcaggcgccaccacgcctggctgatttttgtatttttagtagagatggggtttctccatgttggtcaggctggtctcgaactcctgacctcatgacccgccccattggcctcccaaagtgctgggattacaggcatgagccaccgtgcccagccctgaatttttaaaaagatttgaaattgcacattaaaggaggatactctgtaccagacaatatcaaaccagaatgatcatgaccaaaatatattggaataaaatttctgagctctaaagaaaaagaagatattttgggggatcacggcaaaaagaccaggtgacttaaaagggaaataaaatattggacaataattcattatgccagaaaaatgacatgaaagcattttaaggaaaatcaagtaaagaaaatattactcaaagattttatatccagtaaaactaaatttcaagtagaaaggacacagatagactgaataaagaaaatgtggtacatatacaccagggaatactatgcagccataaaaaggaacaagatcatgttctttgcagcgacatggatgaagctggaagccattatcctcagcaaactaatgcaagaacagaaaaccaaacatgcatgttcttacttacgagtgggagctgaacaatgagaacacatggacacagggagggcacaacacttactggggcatgtcaggggagagcaatgagggggagagcattagagaaaagagctaatacatgctgggcttaatacctaggtgatgggttgataggtgcagcaaaccaccatggcacacatttacctatgtaacaaacctgcacatcctacacatgtaccctggaacttaaaaactaataataataatttttttaaaaagtaaggatgcagataaactatcatcaatgtgcaaaaattcaaggaatcttgttccccataatccctttctgaagaattgtgttaatgtgcttcaaacaaccaaaataactagacagacattgacctaagtatagatggtgagcactgatatattgctccttttagaactgaaagtaaatgagggccctttcctcacaccatatacaacaattaactcaaaatccatgaaaggcctaatgtaagaactaaaactgtgaaactctttgaagaaaatataggtgtacatgtacttgaccctggattggaagtggtttcttagctatgaaacctaaatcacaagcaaccaaagaaaaaaatagataaattggacttcatcaaaattaaaacttttttcaaaagacactatcaagaaaatgaaaagacaatgcacagatagggagaaaatgtttgcaaatcatgtatcgcttaagggtctaatatcagaaaataaatgtatatatttatcctacaaatacagtaaacatgtatttgtaaactgttgcagctcaacagtaaggaaataaacaacccaattaaaaagtgggcaaaagatctgaagtgatgtttctccaacaaaggaaagaaatggccgctgaagaaaacaaaatctatatcttgaagagatatctgcacttcatcttcattgcagcattattcacaatagtcaagttatggaatcaacctaatcatccattgatggatgaaggaattttttaaatgtatgtgtgtgtgcatgtgtgtgtgtgtgtgtgtatgaaatggaatattattcagccataaaaaagaaggaagtcctgtcatttgcaacaacatatatgaacacagaagacattatgctaaatgaaataaaccaggcagagaaggacaaacagtgtatgatctcacttacatgtggaatctaaaaaagttaaactcacagaaacagagtagaatagtggctgccagggactttggggtgggggaaatggggagatgttggtcaaagggcaaaaactttcacttataagatgagtaagctctgagaatctaatgtacagcatgctgattattgttaataacactgtattttgtatttgaaatttgctaagacagatcttcagtgttcacatacacaaagaatggtaattatgtgagatgatggatgtattaatttacttaatcatggaaacaatttcataatgtatatgtatatcaagtcatcacatttcatatcttaaatatatacaattttgtcaattatacttcaataaagctggaaaaatataaacagtaaactcaaagatcgatggatagatagatagatagatagatagatagatagatgatggatagaatgatttagttgtttctccattcattgtaaagttaaagatgaatacaaattatgttgcattcctcttatatacacctaattacatcagagagctaatatgtacctcagaaaaatacatgaaaatgagtgctttataagacaacaaggattgaagctaactgggaaatccttatatacttttatacccctatatacacttaaacaggagtttcaacatcattcctaatttttcagagaagcacatccattttcaaaattattgattcactgaaatttatctctgatcattttcaaatcatattgaattgcgtgaaaccctcgaaaaaaagaaatagccaataagcacatgcagagatgcccaacatcatcagtcattagggaaatgcaaatcaaaaccatggtgagacacctcttcacacacacatgaaaagatgatcataatcaaaactatggacgagagaaagtgtgggtgaggatatggagaaagtggagcctttatacagccagtggaacataaaacggcacaaccacaggccgggcgcggtggctcacgcctgtaattccagaactttgggaggccgaggccggcagatcacgaggtcaggagatcgagaccatcctggctaatacggggaaaccccgtctctactaaaaatacaaaaaattagccgggcgcggtggcgggcgcctgtaatcccagctactcgggaggctgaggcaggagaatggcgtgaacccagaaggcggaacttgcagtgagccaagatcccgccattgcactccagcctgggcaacagagtgagactctgtctcaaaaaaaaaaaaaaaaaaaaaaaatggcacaaccactttggaaaacagtctggcaatttctcaacatgttaaactttgatttaccatatgactcagcaattccagtcataggtatatacccaagagaactgaaaatgtattttcgcacaaaaactaatatacaaatattgacagcactatgattcataatagccaaaaatggtaacaacctatatatccctcaacagatgaatgaacagacaaaatgtggtatatcccaactagacagtattttcagccacagaaagtaattaactattgatacatgctataacacagatgaattttgaaaatattatgctaagtgaaaaaagccagtcacaaaaggccacgattctattggtatgaaatgcccagaagaggcaaatccacagagagaaggaaaatagattaatggctgtcagggctggaaggaggaggaatgggaatctctactaatgggtagaggtttctttttgaggtgacaaaaaagttctaaaattggatagtggtgatggttgcagaactctgtgactatactaaaaaacaatgaattgcgtacactttaaaagagtgaattttatggtatgtgaattatatttcgtaaaggtgttatttttctaaaagaccaatggagggttaaaaagaaagtataggctggccacagaggctgacacctgtaatcccagcactttgggaggccaaggtgggcggatccctttaggtcaggagaattagctgggcgtggtggtgcacacccagctactcaggaggctgagacacgagaatcacttgaacccgggacggggaggttgcaatgagccaagattgcaccactgcactccagcctgggcaacagagcaagatactgtctcaaaaaaataaaaaagaagaaaagaaaaaagaaagaaagtatagtatgctctgattatatgctctgacaatatagatgtaatttggctatttttaaaaacgagttgaatggggaaaacatatgtaaaactgggaactacttgcagtaatcaattgattctggtagtattagtattagcatggggagatacttagcataatacaagattaagcaaatgaggtattatgggatattctatcatcccttgtgttcttgaaaaccaaattctcgaggtagaggaaaggagttggagacatacccaggctaggttacatacagaactctgtagtcctgaatttgaactagaaatgggaatatgagttcatgagataggctatctgtgtagctaaccgtgtgtgtgtgtgtgtgtgtgtgtgtgtgtgtgtgtgtgtgtgtgtgtgtgtttcgtagctctgtccactgaaaaaatctagaaacaatgaccaacccagtagcaatgaacatcccaagggccccaactatggtcctgaaatattacaccatttctcaataagagaaatggctgagctgaagtttgggatcatacaggactgcaaaagagctgtgaaagactgttatactagagcgatgacaaaagggttcaggagcccactttagatgttcttatttgctaaagattaaaacaatttttttctgagtgccaataagaatactcattgtaaggcattcaaacctaccaaatatgtttaaattcagaagtttataatcatatgttttaaaactcactggttgccctcagaggatgataggaaaacaactcattatcttaaaacctggcaaattagaaaacaattatcttgccttcctatatgaagtgtatcattgggaaaccagttagtagatgagaggaagtgtctttttttattttttgagagacagtctcgctctgtcacccaggctggagagcagtggtatgatctcagctcactgcaacctctgccgcctggttcaagcaatctgctggcctcagtctcccgagtagctgggactacaggcatgcaccaccatgcctggttaatttttgtatttttagtagaaacggggtttcaccatgttggccaggctggtctcaaattcttaatctcaagtgatctgcctgcctcagcttcctaaagtgctggaattacaggtgtgagccaccacgcccggctggaagtgtctttttgtaataatactgcaaacaataattgaaaaagatattgaattaaaatgtcatcattttgcaaatcacaattagttaaaagatacaggcactgagcatcgacagcggctaacattgaaaaaagacatgaactgaaacaagacatgaaggcctcctgatgaaagaacaagccatttatatcctgcaatggggatcaagccagactccaattcagtccagttccaggtaccaattttcaggaaactcagaagacagagtaatcatgttgaactgcaccaagagggtacacttggcaaactccagactccaaatgtcctcggcacttcagcctgtaaattgcagggaaaagaaagggatagagggtggcgggcgcctgtaatcccagctacccaggaggctgaggcaggagaatcgcttgaacctgggaggccggggttgtagtgagcagatattgtgccactgtattccagcctgggcagcagagcaagactctgtatcaaaaagaaaagaaagagagatcaagagagagagagagagagggagggagggaggaaggaaggaaggaagagaaagaaagagagagagagagagagagagaaggagaagggagggagggagggaggaaggaaggaaggaaagaaaagacagaaagacagaaggaaggaaggaaggagaaagaggaaacctgtacattaaaagagacttgatgacatagtacaaatttttaatggacaagactaaactataggccggggctgtgactcatgtctgtaatcctagcactttgggaggctgaggcaggcagatcacttgagcttagagttctgggcaacataatgaaaccctgtctctacaaaaaatacaaaaaaattagcctggcatggtgggacgcacctgtagtcccagctactcaggaggatgaagtgagaggatcacttgagccctgggaagttgcggctgccatgacccatgattgtgccgctgcactccagcctgggtgacagagcgagaccttgtctcagaaaaaaaaaaaaagaaaaaagaaaaaaaaggctaaactacagtgtctagggatagctacttgagtgataaaaccatacagaaatgaaaggaagtgattactataaatcagagagtgactactttgaaagagaaggaagaggattgtcattggggccaggcacgtggaggagattctggggcagctggcaaagtttaatttcttgaccagagagggtgattacaagcccactcacctcacaataacttatccagctccacacttgatttgggtggatttctgtgtctgttttgtctttccataaaaaggtttttaaaatctctaccagagcatgtttgtttacaatttcagattaaaacctcgccttcttggctcgtccaagttccatatgaccttcctgcaccatgacttttgttctgtatttgagagcaagtttttaaacaactcaattttgtgtctgacatcaatgaacaaagatgtagatgctgttctggaatctgcctctgcgtgtcttcattcgtcacggagaaggggctgcatatcatcttccagatggtgcttgacaagcacactctttatagaatgaaaggaaactgtggccatgaacaccgcattcagctttccctccgctacctctgcagccttttagatgctaacatagactgcctgccccgctgcggatttacagctattcggatgtcaactctattccttccagactttgtctgcgtcagattagtcaaggcaggcagctgtgatacagacagtaggaaaaacagtaggcttggaatcaagacacctggcctccactggcaactccttccagctctgtaacctgggacaggctgctcaatattcctgcatccgtttcctcatccggaaggtggggattatacacgggattgttgtgagggaggtgatgcgtgaaaaagcaacttgtgaactttgaaatgcactctcaccattcagaggtcttcagcatcctcacacagctcactcccagtgaatttctttctctatgtcattacccacagtaatgggtcacattatcatgctgccctatccaacacaaaaaatgatcagaagatcttattgtcctttgaatgcccttgcagctgggccactgaggtttgaagagatatggtgttggaatgggaagaaggcctcagggggtctcagagccatctggttccctgagtgttctcttgtgtcccttctgaggtgcctggggttccatggccaggttcagcgaccaccttagggtcaggaagtagatatcggccactctgaccctcatgcctgcctcttcagaggagctctgccttatccaatccacatcctggcgcatttgtaagtaagagttcacgtcacaggttctgaaaacaacagcagcaacaagtatgagttcaaggccaggcgcggtggctcacgcctgtaatcctagcactttgcgaggccgaggtgggcagatcacctgaggtcaggagttcgagaccagcctgaccaacatggagaaaccccgtctctactaaaaatacaaaaaattagccaggcgtggtggcaggcacctgtagtcccagctactcaggaggctgaggcaggagaattgcttgaacccaggaagcagaggttgcagtgagcagagatggcgccactgtactccagcctgggcgacagagcaagactccgtctcaaaaaaaaaaaaaaaaaaaaagaaaaagaaaaaaaaatacacttgaaggggagaaggagggaaggaagggaaattttacatgattgatataatggtatgtttaaagacacaacacaaaaggtttttaagggagccaaatattcataaacacactgataagaagcctgtgctttataaatgttctaacataacttcctgttaatatgcaaataatgccccaggggatctataatgtgattctcttcagaagtttaacaaactgctgtgtaaactagtagctattaatactttctgcattcatcttacacattaattaaaccttcaaacattgctgtcagttgttcttttgccaatcttctgtcaaacattattaaatacaatttctcatttctttctatctaaaaacatcctttttttcctgaaatatttaaaaaaacactgtaatgtaccaaaagatttgagaaaacttgtctcttctgggagatgctgtggcaaatcaattccttctaaataattaattttcttgagatcaatgcctaattagttttgcattttcttttaaagaactcactcaattttagaagattattgttaagggaaaacttatttcccgtcttcatgccctggaaggggcagtatcagaacacacagctcgggcttctcgactcctcacttgcttcttccccaaaaggagtgacttatttcatggataagcagaccccatatgtagggcagtgacccccatcctacctgctacctgttatgggttgaattatgtctcctaaaaggtacgttgaaatccaaatctccagtaactgtgaatgtgtctttattttgaaataggatctttgcagatagaatcaggttaaaatgaggtcactacagtgagccctaatccaaaatgactggtatcctcataaaaagagaaggctgggtgcggtggttcacacctgcaatcccagcactttgagagggagaccccatctctgcaaaaaataaaaaaatacagccaggcatggtggtgcacacctgtagtcccagctactcaggaggctgaggtgggaggatcatttgaaacccaggaattcaagcatcgatcacaccattgcactccagcctaggtgacagagtgagaccccatctcaaaagagaagaagaagaagaagaagaagaagaagaagaagaagaagaagaagaagaagaagaagaagaagagagaaaacacagatgtttctacaaaccaagtgtgtatcttcaagccaagcaatgccaaggatggctggcaaacacagaaactagaagaggaaggaaggattctccccaacaaatttcagagaaagcgtggccctcctgacaccttgatcttggacttctagcttccacaactgtgaagtgacaaatttctgttgttaaaccacccagtttggggtactttgttacggctgccttcacagatggatacaccatccttgctctctctgccccctggttctgctggcacccaggcatggcaagggcttcctcaagccaggtctgatctttccaacccatctctcatctgtgccaaaatcaggcaagtcatgctcatgaaattcctataggtctaggttcagggaaggagacaaggggcctgtctttgttttgtgttgctataacagaatacctgaaactgaataacttataaagaaacgtattggctcatggctctggaagctgggaagtccaagactgaggggctgacatctgatgagggccttcttaccatgtcatcctatggtggatgatgagagagtgagagaaagcaagaaggccaaattcaagctcactcccatgataaagttaatccatttgcggggggcggagccctcagggcctaattccctcttaaagttcccacctgttaacactgttgcactggggattctgtttacaacacatgcttcttgggggtgctatagtttggatgtttcacctcttcaaacctcacattgaaatttgatcctcagtgttgaagctgggttctcacgggaggtgtttgggttgtgaggatggatccctcatgaatagattaatgctgtccctggtgggggtggggaagaagtgagtgaattctcactctactttgttgctgcaaaagctggatgttcaaaagaatgggcatctcccttctctcttgcttcctctcttgttatgtgatctctgcaatctctgcacacagcagctccccttcaccttacaccatgagtggaagctccctgaggcccttaccagaagcagatgctggcaccatgcttcttgtaacagcctgcagaaccatgagccgaataataaacctcttttctttagaaattccccagcctcagatattcattacagcaacacaaatagactaagacagagggacacatttgaaccatagcaaatctctctgcagtccagatctgttacttactagcactgctctagaactttccttccgtttgttccttgtgtctatgtttctacaactatgtcatataactatatgtatagttacagcctgccgtttagctataacgtactctcccactgtgtcacttggctcacctcctgtgccagttaacaagctaatgtcagggcaaaatccactcttctattctctgctctttgtggctggtatgccctcattcattcctgatagcttctccactcaagcctgcatcaccctgagtaacttcaacatccccgtgacaactcccccaccagtgacagcctcttgactcctcctctgtatgtcccagtccactccatctcagctgccccctcccataggcatacctaggattttgtcttcaccagaagctgttctcctccaaaatagcaaatccacaaacagcccatgccctgtccatggcttccagcttgctcactcagcaatgttcaccctttgactatcatttcttcccttggctgatattcttatatttgtccttgcctcctccaatctactttatgcatcaaaaacagagaatgcttttcacattgcgtcaggtcactctgtgcatgtcaattatcaatataatgtatatagaaggggcacagactgatggttgccagggaatcataataatggctgttatggaagggtgtggtgagtgtggcttgcagtgatgtaacagtatcttgattgtggtggttacataaatctgcaaatgtggcagaattgcatagaactatatacacacaagtaagtactatgaaactgctgaaatctcaataagctctatggattgtatcaatgttaatgtctcagttttgatattgtactatagttatacaagatgttatggtgggggaaactggatgaagggtacagaggaccttcctgcacattttttttgcaacttctagtgaatctataatcgttttccaaaaaggtttaaaaaaaaaggaaataaaaatttcttcctgaccttctgctaggtggtgaggatgcagctatgagcgcaacaggctgtatctctagactcatatgactgaaacagatagggaggataagttgtggttctcatcactcttgggacaagccaggatcctgaataaggtctattagttcccctaatgggccctgccaatcctggcagcctcacctcccgctgttcttcagtaaccaccttggcttttacaagtttcctagcgtgtaggagcttcctccccgacatgcctcccaactctcacctgggagcagcctcccctgtgctcctaacctggtcaggtccctgtacaggctctgccagctccttgaacctcttctccagaggtgcaatagatctaatctcccctattaaactataagaatcgatgttttcgttgctcatgattaaatcctcagcaatgtacacggtggccagaacataggagtcactcatgaattttttgaatgagtgaatgactgaaagggctttaagcagaggataatgcaatctgatttgctttttaaaaaataaacttttgtgggggctgggcacagtagctcacgcctgtaatcccagcactttgggaggccaaggtgggcaaatcacttgaggtcaggaattcgagacaagcatgaccaatgaggtgaagccccctctctactaaaaatttaaaaattagtcactttgggaggccgaggcgggcggatcacgaggtcaggagatcgagatcatcctggctaacacggtgaaaccccgtctctactaaaaatacaaaaatcattagccgggcgtggtggcaggcacgtgtagccccagctactggggaggctgaggcaggagaatggcgtgaacccaggaggcggagcttggagtgagccgagatcacgccactgcactccagactgggcgacagagtcagactccgtctcaaaaaaaaaaaaaaaaaaaaaaaaaaaaaatttaaaattagccaggtgtgatggcacacacctgtaaacccagcggggagggaactgaggcaggagaatctcttgaacctgggaggcggaggttgcagtgagctgagttcgcgccactacgctccagcctgggcggcagagtgaaactccgtctcaaaaataaaataaaataaaataaaataagcttttgtgttttagggtagctatagaattacagaataattactgaagtagcatagagctcccaaatgttccatacccattttcccctattattattaacatcttaccttaatctggtagatttgtcacaatcaatgaaacaatactgacacattattattcactggagtccatactttgtccagaattcctgtttttctccctaatgttctttttgggatcccatccagaacacacgtccacagtataattagttgtcgcgtctcctacagctcctcgtggtgtgtcagcttctcaggcattccttatctaaagtcttatctatgcttcaccttcttaagagcagctacacagattgaagttcttctgctcgggtttgtctcttcttcactgtgtctttacttatttactggactgtttatttatataaattaatctatccttcattcacctactgaaggacattttggacatatatttatttatataaatatggtctcatggatatttatgttttgggttatagcctcctttttttggtgttcaaattgttctagctttggactttgggggctctttcagttggcctatgtgtccctttaacataaccctttctttatgggaatttattttgtgagcacttcgttattttctggcactaaaagatgctcccggcttatcctgtatatttccaacctgagtcctaggttcagcctttctcaaaaaagccctggttccttccactgaaaatggtattagaaaccaagctctgagcagtaggtatgctcattgctactggggagtcattgcttcattgcttgtaggcctgctcagttggcagaagagcaaaatatattaggtttgtgcaaaagtaattgcggttttgctgttacttttaatgtaactgtctgtatctataattctatatgtaaccatttatagatatacctctgcatatatataatgctgtgtgtaaccatctgcatctatattgagaagcatgagttcctactgaatgcttcacctctaatccattaccacatagatccttccagactcctctctttatctggaatctcccatgcctgcagtgaggagcctagcttccattatttgcttactttagttaattctttaatcccagtatacgtgtacggtggtttcagaattgttagctcatatccctagggggcacaactttatcagctagaatagagtgtgtatgtagagttcctgtgcctttagtcattcatttccaaagatacctaagccagcactttattcctcatctccttcaacaacattgttccatacatttgtggtacatttagatccttttgtcgcattctgcctctcattctgggttccccaacatcctaattatttttatttttttatttttttttagacagattcttgctctgttattcaggctggagtgcagtggtatgatctcagctcactgcaacctctgtttcctgggttcaagccattctccctgcctcagcttcccgagtagctgggattacaggcgcccgctgccatgcccagctaatttttgtattttttagtagagacaggctttcgccatgctaactaggctggtcttgaactcctgaactcaaatgatcctctcatctcagcctcccaaagtgctgggattacagatgtgagccaccgcactcggctcctaattttttttaaatttacctgattagggtttgctctctgcactgtaaagttcatagaaatcccccatagggttttgccaaatccttgtatatgccattatagtatcactcatacaaaaaaaaaaaaaaatccctgtgcttcacctattcaatcatccccccaacttctaacctcttggcaaacactgatctgtttattgtctctgtcgcttgctttttccagaatgtcatatagttggactcatacagtatattgctttttcagactagtttatttcatttagcaatatgcatttaagattcatccataactagagtcaggcgcggtggctcatgcctgtaatcccagcactttgggaggctgaggcaggtggatcagctgaggtcaggagttcgagaccagcctggccaacatggagaaaccccatctctactaaaaatacaaaattagccaggcctggtagtgaacgcctgtaatcccagctactcaggaggctgaggcaggagaatcgcttgaacccgggaggcggaggttgctgtgagccgagattgcgccattgcactctagcctgggcaacaagagcgaaactctgtctcaaaaaaaaaaaaaagattcatccataactttgttgggcttgatagctcagttctagttgctgaataatattctattgtgtgaatgtaccatagtttgttcatccattcacctattgaaggatatattggttgcttctaattttggaccattatgaatagagctgctataaacattggcatgctggtttatgtagggacatacgcttccaaatcagttcagtttcaaatcacctgagtgtgattgttgactctgatagtaagactatgtttaggctgggcacagtggctcatgtctgtaatcccagcattttgggaggccgaggagtgtggattgcttgagcccaggagttcaagaccagcctgggcaacatgatgaaaccctgtgtttccaaaatatacaaagattagccaggcctcatggcatgcaccgtgtagtcccagatactaaggaggctgaggatgggggatctcttgagcctgggaggcagaggttgcagtgaggtaagatcacaccacgcactctagccggggcaacagagtgagacccctgtctcaaaaaaaaaagaaaaagactaggtttagttttgtaagaaagcgcaaattctcttccaaagtggctgtaccatttttgcattcccaccaataaatgaacattcctgttgctccacatcccctccagcagttggtattgttggtttttggatgtccgccattctagtagatgtgtgggggtatgtcattattgtggtgatttgcaattctctagtaacaaattatgtttaactacagattaagtattctaaaatcatcattttgggccaatgcccattatttaactggcttaacagtaataataatattgattcagaaattttatttagtcagttatttaagagaacattttgcagctagttttgcttgaggtgttcatcaggtcatgacatggtttaaagctatttcatcattgcactgatgagatattttatcattgcactggtaagatattttatcactaagattatatctgttttaaaattttcaaactaaaactactaaatgtatggtaacaaattttgaggcttccattcatccattgttgaagtgacctaaaatcttttttttctttctttctttttttctttttttgagacggagtctcgctttgtcgcccaggctggagtgcagtggcgtgatcttggctcactgcaagcttcacctctcaggttcacgctgttctcctgcctcagcctccggagtagctgggactacaggcgcccgccaccgcgcccagctaattttttgtatttttagtagagacggggtttcaccgtgttagccaggatggtctcggtctcctgacctcgtgatccgcccgcctcggcctcccaaagtgctgggattacaggcatgagccacggcgcctggccaaagtgacctaaaatcttgacccagtccaagggtacttcctcatcccatctccatgcagggaatgttcatccttttagaacatgttgatagcaagtccatcatttttaagaggatttttaaaccatattctcagctctactggatgttaaatcatgtgactatgaacttaataggcaacgtgcatcacaggacatgtcagggaagataggttcaaatgtattgctgctgagcatgcacagaaagcttaagtaagagaaataataatgatgcaggattacttgaaggctgtattgaccatctattcatttagactaataaggatggagatagattcaaattgatcacaatggtgatgctctaaagagacagaccatgaggttctgcttcccagttccctagaactcccttggtccaggaccttctgagggctggtggttgaggttttcatttgattctcacagttgatagagcaaactttaagaagctgatatagaggagaaaaaggatcaagttaggcatcaggttcctgggtccactacctaacaccagtgcttccttggacaagttacttaagctccataagcctatttcctcatgtggaaactggtcataacaatcgcattataatccctactttgtccaaattagatgaacactgtgtgtaagacagcaccattgtcttacaaagcagttacaaactggcagccagatcaggcacaggggcaggccatttaccctgcaagatgatatatgttttaaaagtttgagtcaactttttcaagttcaaaaacttcatattaagccaagatttatggcttcctttaaaaactttaatggatctcacaatacagtccctacatttccaagagccgagcagcagccctgccctttaggcaaagcaccagctctccaggtgcctcagctccctaccttcctagctgtctctatgttttttttattaaaaccacaaataaactgtaaagccataaaataagtgattaatattattgctggagataacttacggaaggcttcttaacacctgagaggcgatgtttcactcagagtaaaggtgagggtagcctctatacggctggtgacagaaggtgcccatggcacaattcagtttgttgagccaaattttctgtgcttcattccacagtctttgtaatctgagcatgcatggcttgagaaacactttttaggcacacactttgatataaaacaatttgtcaaaaaaaaaagatgctggaaattccagagtcaagtagtctgccttactgacatcattcatggcaataatattatatgggctgctatgagcatctgctcaatattatatgggctgctaggggcatctgcccactttcctagaatgccacttttctttcactgggtctatccaaattggaaactccaaagcccatcccagttctctcccaccatcatcatcatcatcatcatcatcatcatcaatcatcatcatcgtcatctcatcatcatagatgtgatgatgatgatctctctctcccttgacctcttagggaaattactatctataaaaattaactggcaatgagtcacatgttgctttgaaacctgttctatcatatcatgatgtcttattgtatgacctataatttatttgattcttttgtagggacagggtcttgctatattgccggggccagtctcaaactcctggcctcaagtgatcctcccacctcagcctttcaagtagctgagactacaggcatgagccaccacacccagcttatgacttaattattcatatacaggtagtattcactttgcatggtactgtggaactgtaaaaatcaccatgcaatctgaaaccacgcaaagaaatattaataatcaatggggaaaatatgatttttctttctttttttttttttgagacagagtctcgctcttttgcccaggctggagtgcagtggcgcgatctctgctcactgcaagctccgcctcccgggttcacgccattctcctgcctcagcctcccaagtagctgggattacaggtgcccgccaccacgcccggctaattttttgtattttcagtagagacggggtttcaccgtgttagccaggatggtctcgatctcctgacctcgtgatccgcctgcctcggcctcccaaagtgctgggattacaggcgtgagccaccgcgcccggcctgatttttcaatgatacgttctaatgcttgtaaaaacattaaaatctctcttactggcagttataaacaataggaaaatgaaaaggaacagtaaaactgatatttgattatgccttggtgaattggcatactcctttctaagtttgcatcacttccaacattttcccctttgtgctttcaatgtcataaaatatatctgagagttccattaacttaaagtgtttccccaccaccaccttttttttttttttctagagttacttcctctggggtatcttcttcattctttttgtcatgaccttttccctcatttatgtctgtaagtttattgtcaataagtccttctggctgtatatctagagtttctccgaaggtggcagggtcaacattcacatgatcagctatgtcttccataactccacatggtcagctatttcttctataactccatttacatcccattcaaatttcacttccatctttaacactttttgtttcttttgtgtactttcatctttgttggccaatttgaccttctaattatctgtttttataaaatgccacctgggtttatcactgagaatcaccgaggcagcacaactacacactttgctggcagtgcaattgaatgacatatgcacaatgaccaatcactgcagattttgaaagaacttgctgcgattggtcaccaagcactgcaggtgttggaataaaggtcatgattggtaactgactgtggtgcgcatctgttacttacatagtgatttgtggactgaagagctagcagccccatttgtgctccatgcaatgactcacagttaatatgccatggtaactgtaatttgaaccgtgttgttggaagactgagttatttaatgaaaccatggtaaatgagttcgtttcatgcttaatcagaaccacgagaagcaaagcctgcctgtatttgtattctgtcttcacaagtccagtgtaagccccatgagggcaggacccatgactcaagaagtcatctgcacatattccccatgctcaccccaagcacctactacagtaccttgtgtatgaaaaaatactcgataaatatttactgaattttattttcttcaccagagaaagaactgtgtagatgtaacacagtattgaaagtcaagagacttcaattcttggtctgggtctggaactaattgagtatgatttttcagacactctctcttttaaaaaaatgtattttaagcaaaatctctacctatggtaaggatataatcagaattctaacaactattgtgtcttagtcatattcaagatgaaaaaactgttttagtttattattttattatttatattattttattattttttgagatggagtcttgctttgttgcccagtctggagtgcagtggcgcgatctcagctcattgcaacctccacctcctggattcatgcaattctcatgcctcagcctcctgagtagctgggattacaggcatgcaccaacatgcccggctaatttttgtatttttattagagatatattccctctttcagtgttcctgggagctccttaatgagccaaaacacaaagccattctgacagagaatgctggctgtcagctgcattcattcagagctaagtgatctgatccacacaccagcctaacagccaaagtgatctcactaaaatgaccaatatcactgcaaaggaaggttttccaggccaagagaacgtgcatgtgcaaagaccctggggcaagaaagaacctggcatttcgtagctaccaaaagcccatatgcaggagagcacagagggcagaaagatgtgaagagaatcacgagatggcccaatgacgaaaggggaagagctggaagggagtgccatgagcccctgttgaaatccctctggctgcagtgtggtgagtggatggcagaagagtcacaaaggatgtgggggaagaagctgtgaaaggatgccagaagagatgtgatgtgacctggccctgggtggaagcaagggagatgggaacaaaggcatagcttccagagaggtcaagatgtcaaaccagtgtttgaggcaggtggtccatgtgtggtcccagaacagcagcatcagcagcatctgcagggaacttgttagaacacgaattctcaggcccactgtagacttcctgaatcagaagctctgagatttctgaacagttggggttttctcaagccctctggaggagtctgcctcttgctcaagtgtgaggtccaccagacgaggtgatagaaacagaaaagaacctgcaaagatgactcctgagcaagggggctctcccacagggcctgggtgtcagtgagtgctcttcgggggcaagagagaaccctgggaagcactgagaagcagacagcaaagcccctccaaaaaatggtgtgaaactccaatttcattttatttaattaattaatttatttatttatttgagacagagcctcgctctgtcatccaggccagagtgcaatggcatgatcttggctcactgcaacctccgccgcccgggttcaagcgattctcctgcctcagcctcccgagtagctgggattataggcaagcaccaccacgcctggctaactttcgtatttttaggagagatggggtttcactatgttggccaggctggtcttgaactcgtgacctcaggtgatccgcctgccttggcctcccaaagtactccgattataggcatgagccaacatgcctggcctgaaactccaattttaatttgaaggacacatttgacaacatatgaattaaatatatctatatggtagatttctcaccaagaatttagatgaaaaaaagagggaaaggagacagttgcaacatttatgacgagggaaacggtcactatccctaatatgcaaaggagtccatgaggaaactcgatagaaaactggataaagaaagtgagtgggaatttcacaaaacgaagaaataccgataatgaataaaaagatcatcagtctacttagtaaccaaggcaatgcaaattaaagtggcaatgacatttctgcctatcagatggccacaagaattttttagaccaaataacatccagtggatcatattccacattgtggtcgagaatagaaattggtacaatcttcggtgatggtaatttgatggagtcttttaaaacttaaaaatgctcattctctgaaaatgagcagaaaaaaagaatttgtatgacaataatttttgaaagtgataaaataaactgttaagacagtttaatttctacgtagataccatcttattcataacatattataccaagtaattctcaatttactttcaaggtaattataaatccctgaagtcattatacatctcacccaaggaattataatatctagcaataacaaaaatacattgaaaaggagtaaactgctcagcagattttgaatattttattttgaaattcaacgtggaacttaaccaaaatattgttttatttctcttggcaaagtatctcaacagagagctatttccctaggaaaaaaagaaaatcttttattccctatgaaatcaagtccactctaaggaagctgattaggaaggagaactgagtgcctcaagctcagtagtgctgtcccgtgaagatgatgtgacttggcccccaaagggtggaagagcccttaccggcatcacgagtaagggcaggtgagaaaggtgggcacctgcaggtggtgctctggggtctacacacagtgacatgcacaggtgacacaaaccgtggtatttataggagtattcaaaggcaggctaacctcaaacactctcagcttagaaatgtacagatagataacgtttaaactgagacaaagctttgcagtttatgtgaagctcaaatgctgctgaagctgctctgtttcctggcccacccatccaccagcctgtgtatcctccccaatgaacaaatgatggaccaaaatgtggtatggcaaatggcaaatgtaaaactggagcaaagagattgtcaggctctttgagaatattactttttctaaaatatagttgattgattattcttttgagagataatcataggcccagtggaagttcaaaggtatatatcgaaagtcaattggcctcccaccctctgaacttgctttgaattccttgtgtgtcctcccaggacagtctatgcatacacaaatacctcctctatgtgtaaatgtcagtggcatgctattcacactcttctgagtttgtcttatttcacttaaccatatactttggaaattgatccacatctgtatctctaaatctgactcattttttaaaagtcattttattttaaataaaatgtggattcagggcagggcatggtagcacatgcctgtaatcccagcactttgggagaccaaggcaggcagatcacctgaggtcaggagttcaagaccagcctggccaacatggtgaaaccctgtctctacaaaaatacaaaaactagctgggcatgatgggggggtgcctataatcccagctactcgggaggctgaggtaggagaattgcttgaacctgggaggcagaggttgcagtgagccgagagcaccattgcactccagcttgggtgacagagtgagacaccatatcaaaagaaaaaaataaaatatggattcagaaaactgcaaaataaaatatatggcttaatgaattatttgaaggtaaatactacctaggataagaaatagaactttgccagccaccccagaagcacctccatattccctacctaatccctgtcttctccctcccaccataagtgacattaatctgacttgttttcatttttatttttatagctttatcacccaaatttgctcccctagaccttatactttagtcctacctattctaaaaaatgtgtgctaggtcttttaagtctcttttaatctatatggttcctcctccatccatttcatttctttacaacttatcgttgacaaatctgggctagtcgaatttcccatgtctgtctttttcttttcttttccttctttttttttttttttagatggggtctcactctgtcacccagactggagtgcagtggctcaatctcggctcactgcaacctccacctcctgggttcaagtgattatcctgcctcagcctccagagtaggtgggactacaagcgcgcgccaccacacctggctaattttctgtatttttagtagagacggggtttcaccatgttagccaggatggtcttgatctcctgaccttgtgatccacccgcctcagcctcccaaattgcatgttggtagcaatttgctatgccctttacacttaagggtcagtttttctgggtataacatttttggcttatactgtctttccttgagtatgttaaatatgctaatccattctcctttggtataaagcatttttctcaaaaaatcctggtaatagtctatttttcttttccttataagtcacataagactttttcaagatgtccaaagaatttctctagaggttcaaatgattttttttttcttaagtactaataatttcagtaggatatatcttgacagcagtcatcctgggccgatattctcaagtgtgcattgaaccttttctttctttctttctttcttttttgagacaggttcttgctctgtcacccaggctggagtgagtacagtggtacaacctcagctaactgcaacctctgcctcccgggttcaagcaattctagtgccccagcttcctgagtagctgggattacaggtgcaagccaccacacccagctaatttttgtattattatagaaatgagatttcaccatgttggccaggctgttctcgaattcctggcctcaagtgatctgctcacctcagcctcccaaagtgctgagattacaggcatgagccaccgcattcacatttcaatatacattatcaaatcttttatttcaaggaagttttcttggattatagctcttagtacttcctctgttctcttgctttggttttcttcatgaggaaaacctattattcatatgtacaatagccttcaatgttcactactttctcttaaatccttctctcttcatttctttttttttttttttgtcttatttcaccttttatgtctctcgaggcattacccttgtatttgtttacttttgtgttccttccaggaacacaggtattgacatccatcaaatgtatttaaatccatggattcataataattagtctaccttacagaataattatttttagttctacttttttcctgagttgtcacttcatttccaagtttctctaattctgattgatgctgttctgccatgtctatcatgtacttaatgtctttttctgaaatagatcaaacagaagcttgctgttttatgactatgtctctctgccatgacttgtcagttacagtgttaccctattctttattctctctagtttttaaaattactttgcataggattgaacttgatactcttctagtgctcgttttttcatgtgaaatcaagttttcctaaacttttagaacaagtcagggttccctagggggacagaactaatagaatagagggatagatagatagatagatagatagatagacagacagacagacagatagatagatatagatagatagacagagaaaggggagtttattaagtattaaattatatggtcacaaggtcccacaataggccgtctgcaagcctgaggaacaaggagagccggtccgagtcccaaaactgaagaacttggagtctgatgtttgagggcaggaagcatccagcatggaagaaagatgtaggctgggagactaggccagtcttgccttttcacgtttttctgcctgctttatatttgctggcagctgattagattgtgcccaccagattaagggtgggtctacctctccaagcccactgactcaaatgttaatctcctttggcaacacctcacagacacacccaggatcaatactttgcatccttcaatccaatcaagttgacactcagtactaatcatcacaaaggccatgttaaggaatgcttttcaaacttcacagggctcctacttctgtgttcaaaaatagagccacctgctttcagggatttgctggctgtttctttcccccaatgcagatggaaactgctccttcctttctttcatccttgtcttgctcaattttgattcctctcccagcgctttctcctgagtgtggagcccttcctgatcagtcttgggaattcctaggggctcgactgctcctgcctcctcctgcctcctcctgccttctttattattattattattattattattatttatttattattattattttttgagacagagtctcgctctgttacccaggctggagtgcagtggcgccatctcggctcactgcaagctccgcctcccaggttcgcctcccaggttcgcccattctcctgactcagcctcccgagtagctgggactacaggcacctgccaccacacctggctaatttttttgtatttttagtagagacagggtttcaccctgttagccaggatggtctcgatctcctgacctcgtgatgcgcccgcctcggcctcctaaagtgctgggattacaggcttgagccaccgtgcctggcctcctcctgccttcttactgtgggcacctgaactacctcgcactagagaggcaactcttcagctccacctgctcgtctcgaattggcccacaatactttctagtgaatactggtatatctggggttcttctgttctcaggtctatcatgcctcacccccttgctttctaacttctttcagcccctcaaacccagataccatgcaactcttgaggctgttggccatttatatatgctaggttagtgggaataatttgtcacctagttttgtcataaatattttccttgggttgtgggttttgctgcctagtttctgtgtgtctgcatggggacttggaaaaactgaaaacttggacccctttgcctagaatctggtttattctttataacaggggcactgtatttatctaaccagtcccctattgatggatatgtgggttgtttctgaattttgctatcacaatcaatgtgccctattattgtttgaatgtttgccccctcccaaactcatgttgaaatttaattaccattgtaacagtattaagaggtgggacctctaagaggtgattaggccatgagggctctgccctcatgaatggattaatactgttattgtgggagtggattcacccccgttcatctctctctcacctctctttgcccttctgccatgttatgactgatcaagaaggccctcaccccatacacagttcccagaactgtgcaccagtcatctgtttattatagattgcccaatctataatattaattattattgttacccaattattactaattaatactcaatctataataataataatctgtttattatatattacccaatctgtgatattcagtcattgcagcacaaaatggaccaagtcataccctttacacaagtgcatatgagcaggtacatctgtaggatacatttctagaggtggaatagttcaataaggatatgaacacagtaggtgctcaaaaatatttgctaatttgagttagaaaatgtatttgccacaatagtaataaaatttgttctggcccacagcccaggtagacttctattgagaacaatgtacttaaatactgttaagcacaactttggggctccttgagcagaagaaagaggaaacaaaaaaagacactgattcattcctgcagttagcaatcaggtgttgcctagtgtactacagactctactggggcctggggatatagcagaggtcctagccctgttggagctcacagttcagagtggagatgcctttgttgtttgagcaactttgagaattaaatgattgctcttcatactcacaattgagtaacacttcgtaaaacgtaccatccaatctttgtctacacctagaaaaacttcagggtaaatttcagtgcagagcacagggagaacagctgtccaggataaatacttagatgtcagctgtccatttggtcatatgccatttctgagagtcagtctacaacctcctcttcagaaggcacccaaggttttctgtaaacagatgaggctgcttcaggggtacactgcgatgcttcattcctgttggtactggagtacaaatctgggaactttaaaatgcatcgatggtggaaaaaaagaaaaaaacaaaacaaaaacaaatagcaaaagcggtgtgcattgcttcagtttcagccaagttcattctctcttccagaaacccagcttccatgctgatgtccttaagccatcaatgccgtcaacaatgctgttattccctaagttcagggtcaataaaggcagagctagctccgcagctcatggcaaagatctccatttggccataacattttcccagattgacctcgtaatgtttttcaacacggtgctctggacaacctctacaaagaggtgaaggcatccaagctgagtctcatctcccatcccctatgtgactattctgcactgaaacctgggactcttcctccttctttatccctctgcagtgattcagtccccaagtccaagtctattccaatgatcccttcacctctatatttcttctactctttctgatcatcctccataagttctgctgccagattaacctgtcacccctttgaagccatgattcatgtgggctggtctcaggctgatgtgatgttcaaagaaacgcagtctagcatccacttgtattttcaaaaattgctcccgtcctttatgtctctttagtcccatgcaggagatactttgcctatagaaacatttctcaaacaccctctttgtctgtctcctactcccatcacttcctggggcttcttctgtgctttcttgtctaaactcccccagtccctagccccggactctgagacacttctcactccacccttcccccttccctggtctttgcatcacaaaagcccaaagagtcagcagggaaatgacccagcctttcttagagagcttggggaaagaaacctggtggggaaactcttttagtcggacagacagaggcatattaaaactcattaaaaaaaaaactcttaaaaaagaaaaacactttgtaaatgtaattttttctgctccttgacacagattttcccatcatcccctagcgtctaatggatagagtccacgctcctggcctgggagtcaagaccctccacgtgcacccttaacttatgtctcaagcttctctactgcttcccagccttacccctctgcccttcccagccactttatctgctgtccctgaccacaccaccaatatcccagcatgctggctcctctcttcttccccatccaattcccgattttccttccagtgtcatctcaagtggctttatctcggggtttgatgttttctgctcctcccaaacctcccaagccttctgactcttcataagagtttgttcggtgaatgaatgaagccctcacttcatgcccttctctggtacaggaatcgcatcattcaggaagcttctttgagcaactaacaggcattttcttagcttatttcgttgcctttaaaccaaggctgccatttctgcctgtgcgttctgtctgccttcgctgcacctccactccttcaagcttggattgatgacttctgttctctaattttatctgggcaatcaaattcccaaaatatgtgtaaaagagaagattgcattcctattttacaaacgtggcaactctgtggaatttttaatcagataccagcttttctgcatctctgtgatgtttttcctccttcggagtcagtagatagggccttttgctttgcattgttgaccattgtccttgccttctgacattttttgctgtcttcctcacgtgcattccacagtcagaatactgggctttgtccttccctctttcattacaagaagctctgctataaggatgttttgtgggttcctcagctctaatgaaattccaggcatttccttgaagctggcccccagggagaagctactctcactggtctgtgacgctcagctagagaggagatgacggcgtgagtttggttctgggctggaatttcttgttgcaacatcccagcgtggcccctcttagaaccttcccaccaccacattcaaatcttattcctccagcctctggcacaccttcagcctgctaccagcagagaaaaaaaaaaaaaagacatatgttcttgctccatatatccttgaggtgggcaaaaaaattaaatgttaaccatggaggaaattgtgcacatccagacaggacactgtggcagtcagatcagtgccaaattctgggaagttatcagtgatggtcatagcatggacctaccagtacctgcccagggaccacgatctgtagctggaccacatcttggtgtgccacagtgaaggcactggggacaaatatgttcctcccactatcctggtggatccagaacctgggatcatggactctgctcagatccttttgaaaccatgccccaaagagttaaagaaaccagtgactcacagaaattcttaagcctgcaggatggcagataagaaaagaaacagcttgctgaaattccctccaactataaggtaacaaaacaggctgaaatcagttgaaaccaatacggcccactggagtatacgcagaacgagactggtgatgctacgacctgaatttcctctgcatgtttcatcctaactcccccagaatttgcacgtgggccccataaaaaggcaggaagagataattgtccatgcccaaggactttgcagaccacccttttcactccctgaaccttttctaacaaaagtacagccttatgcccagcacagggagaccgatttgagctagaatgctatctccttgttgatagacctgcaataaaaagcgtttcttttctgaaaaacccagtgtcatagcgttggcttctagcgcatcgggtagtgagcacttttgcttagatctgcagaccagaccactttgttttcggtcagtttggggcaggcagcagtacacagtggagctgagctggttgattcattcctggatatgtgcagaaggaagctgagagctgtgactgccttcagggcttccagctgacccactcactgggtgagggcacaggctctggaatgggcaccctcctccacagcaagatccgagaagaggatcctgaccacatcatgaacacctccagtgtaatgccctcactcaaagtgtttggcactgtggctgagccctgcagtgccccctccccatccatccactggtagagaacactgatgagacctgcggcacagacattgaggctccttataatattcgcttccgcaccctcgagctgaccacacaaaactatgaggacctgacccacctgtctcagctaacatgcgtggggtcaccaccttcctctgcttccctcaccagctcaattcggacctctgcaagctagcagtcaatacagtgtccttcccacgcctccagttcttcatggctacctttgcccctctcaccagttgtggaagccagctgtatagggctctcaccatgcccaaactcacccagcaggtctttgatgccaagaacatgatggctgccccaccaggactgccttcttccatgaatatccatccattcatgaaggaagtcaatgagcagatgctcagtgtgcagaacaagagtcgccagcagctatttcatggaatggatgctaacaacggtcaagacagccatgtgggacatccttcctcatggccacaagatggcggtcacgttcgtcggcaacagcgcggccacccagaagctctccatggcctctcagggcagttccctgctgtattgtgcgggaaggctgtcctccactggtatgcaggggagggcatgaacgagatggagttcgctgaggccgagaacaacatgaatgacttcatctctgaacatcgacagtctaggacgccgccgcagaagagggagaggactcagtgaggaagcccagtgggaggcctaaggcagagctcccatcacctctggcatctcaattccttcagccttcttccttggctgcccctttcttctccctcagtagtcgtgtttgctgcctttaccttgtttatctggggagagggagggtctagagcagtgcctggtacatagtaagtgctcaataaatatttgtctgctgaatgtctcctctctctttccactccaggaaacctagatttctgccgatctgggtaaccgtgtatttccttctggtaccctcctcccatctgcccaattaatatgtccctctgttttcaaaataattctccaggaagctgggtcccattcagatcccatttagaaccaaccgggtgctgaaaacccagataatgtgcaccatcctatgtccacgtagtagccagcactgggaaggtagaaggtggcaggaagaagttactgcaaggggctgggcatggtggctcacgccagtcatcccagcactttgagaggctgaggctggaagattgcttgagcttagatgtttgaaaccagcctgggcaacatagcaagaccacgtctctattttttttttaagtaacaataaaaaaaaagaaagaagttactgcaaggaagaggatgggattttccattctagaacggttttggagagggaaatccaggctcataaagccataattcccaggtatttctgtgctccaattctcaggttcaggggaggtggtaacagcattatcccattttcagtttcctttggaggagtcgccccgcttcaccaagagaggtctttccttctcccaccactcctcttctctcacaaatttttttttcttttttttttttttgagacggagtctccctccattgcccaggctggagtgtaatggtgcgatctcagctcactgcaacctctgccttccgggttcaagcgattctgctgcctcagcttcctgagtagctgggatcacaggcacacaccaccatgctgggctaattcttgtatttttaatggagctgggttttcaccatgttggccagtctggtctcgaactcctgacctcaggtgatccgcccacctctgcctcccaaagtgctgggattagacgtgagccacaacgcctggccccctctcacattttggatcccttccttttccctaatcagaaaaggagattaagagggagagatctgcctgggtcccttagcctctagaaatgccctctccattcccaatttgtcttaccccttaaaaggtgtaacatccctgacatatgtgggaaggtgtgttcccccacctaaatgtttgagtcattcccaagatgagaggggatggggcaacatctcatctcttccttttgctattcccttttttcccctgctcttggttttgtcctaccctacacttcagatttctattttgggttgaacttgctgctttttcctcataatgaaaagatgacattgtcccaagagccaaaattaaatgggaattggaaaaaaatccactgtgcagattgtctttcttccctacccggcagggatgatacagggaagcagcgtccaataccacctttgttaagagcctagaagctcaaagtgtgggcactcctgagagagggccctcatgcacatgccatggcaccagaggacctggtgggacagcagcccccaccccggttcacagagcagctgccatcgcccaggctaacctggagcatgcaggtaacagtgtctgttggaggatcacacatatgttgttgctagacaatgtaccctgaacaatgcaaatatacagcagttttgcaaacatcagagcagacaaaagtcattcttgatgtattaccctcaatttggaataaatcctttgtgcaacagagcatttcccttaccctttataaaaagctccttttaaggcagacctttggacaaaccaaggggacgatgaccccttggtcagacttctttttaccaggatgtggcagagttagcctgcagtgtgagaagacaagtcctctgacaccacttgaaggggctgagacagacccggtcagggctgatggctgtcagagggctcaccactccacactcagaggtggatttttttccaattcccctgctctgtgagacagtcacactcacagagtgtctctttagaagcttttatggaagcttttaaatttgcttcacaaaatgttaacctggctgtgttttctgcattgcatatatttaaggtgtatgacttgatgatctgattggttgaatttttgattgtttaccttttccttttttcatactgctttaagtataacaaaaagggaaaggaaacttttaaaatacattggatctcatttcccctttacagacaagtattttgcttcctatgactcaacttttatattagtcaggattctccagagaaacacactcaataggctatacagagataaataagaggaaatttaggggctgggcatggtgcctcacacctgtaaacccagcactttgggaggctgaggcaggcagatcacttgaggtcaggagtttcagaccagcctggcccatctctactaaaaatacaaaaattagccaggtgtggtggcacatgcctgtaatctcagctactccggaggctgaggcaagagaatcacttgaacctgggaggcggaggttgcagtgagccgagatcatgccactgcactccagtctgggcaactgagtgagacgccctctcaaattataataaaaataaataaataaataagataagatttattataggaactggctcatgtgattatggaggctgggaagtcccacggcaggctgtctgcaggctggaggcccgggaaagccaggggtgtactgcagcctgagcccaaaggccagagaacctggggagcttatggtgtaagtcctggagtccaaaggcctgagcaccaggaatgcacacgtccaagggctggagaaaatgcaggtcccagatccagaaaagagagagagagaattccctttgcctcctccttttttgttttgtctggcttctcagtggatgggatatgcccacccacattggtgagggtgatctttacttagtcaatggattcaaatgccaatccctttcagaaacaccctcacacacacccagaaagactgctctacaggccatctgggcatcccttaatccagtcaagttgacctgtgacattagctgctgcaactcattatttcatgtcttcagctgcgatattaagaaacatgatggaatccatcaacctacgccatcagcattcatcaacacaggtgcaacttaggttaaaagatgaggctttgggggaagatattcaaagcaccaagccctacttgtcaccaaaagcagaatttcagatcagtgggtggacattgggcaggaggcgctcttatgtggcatctctcagagagctctgcagggtctcatcccgatggctgcacaaggtggtgggtgacggggatgcccgctgagcctgaggcccagggcagcctgacagagggcctgtgtctcagccctctcgggcagaaggttaggaccaggcagcctggcatcttgatttccacagcccttttcctcatcctcttggtctcatgtcctgctctggactctctaactagctggttagttcctgaccaaggttgggcttcctccactcccacctctgtttctgtttcctaattttcgtgggctgcctatctctttcttagagtcttagaaataatggctagttcatctgtctgtagccatgtctatagtgtccataggcttaaaaatgttttcacagaggccgggcgtggtagctcacgcctgtaattccagcactttgggaggccgagtcgggcagatcacaaggtcaggagttcgagaccagcctgaccaacatagtgaaaccccgtctctactaaaaatacaaaaaattagctgggcgtggtggcagacccctgtaatcccagctatttgggaggctaaaacaggagaatcgattgaacccgggaggcggaggttgcagtgagctgagatcacgccattgcactccagttcaggcgacagtgtgagactctgtctcaaaaaaaaaaaaaaaaaatgttttcacagatgatccaggaaacgcactttgaagggtcctaaatctgctttccctcccgtgagcctcttgtgaatctgaagttctcagcaggttgccagccactaatagaacagagaaacacagaaatcaatgcgaaaacctttgttgctatgttcttcttacaaaaattacagacatgtcctaggtaagataagcatatgttctctgataatgatgatcaatatcattcttctctgaaatgcaatctagaaaacaggtccccagaggctgccctgatgggtggtggctgccagcagtgtgccctgaaggagactgatctggtcacatggccctcccaccccagggtggcagcacccacagacttaggagagacacacaggagggtgactcagcctggctctcaagaaagggccaaaacacccttggtgagaaagcacagaagacgctaagacaacccctggagaaaccaaaggaagaaagttacatgcaggagacagagcctaagcagacaagagctggaagattcccctggctgcggctggagtggaggaggaccacactcccagtgcagagccacccggcaggggcccatttgagttttgaagcgaaatcaccctttctgagtactctttgtgtgtcaggcatgtgctagctgttttgcatgcatggctgggcgcggtggctcacgcctgtaatcccagcactttggaaggccaagacaggtggatcacaaggtcaggagatcaagaccatcctggctaacacggtgaaaccccatctctactaaaaatacaaaaaattggccaggtgtggtcgctggcgcctgtaatcccagctacttgggaggctgaggcaggaaaattgcttgaacccaggaggcggaggttgcagtgagcctaggttgtgtcactgcactcccagcctgggtgacagagcgagactccatctcaaaaataaataaataaataagtcacaacaacctcatgagatagacatccttacttacagatggggaaactgaaacactgagggttaaataactcgctaaatatcccatggctggtcatggtgtagctgggacacacacaaacccaggcctatcaactccagtgcctacacgcttatccagtgcctctagagggacagacacagtactgaaaagtgcctgtgaaagacaaagtgtcacctgtctcattgcagtagtggacaaatggaactctgactgctcaggaaagaagaggtcggtgctcttggagcttcactctcttgtcccatgcaggtgcagggtagaggctacggatttcctgacacccaccctcctggccatcccctgatctcatcaccaggctcatcctcccactcctggccacgtgcctggaggttctcctgtctctgcctcaggtggcttttctggtttctgggccatctctcatggcctctgtgagccctgtcctcccatgactcacagtttgctccctgaatctcaccctcagactctaactggaggatccattccagctttcccgcatctcagtcccagtgagtggttctgtgtctgtgaagcctcagaagcagaaccaatgggatgatatagaatgtgggggtttattataggaatttgatctcatgcaaatgtgggaactggttagagtttatgtacgttttttgcttctgtgcctggtcagctgtgaggaaggacagatgacacaaagtgaggaaaaggacaagctcaccctggagaatgagtttggagccctcctgggcttctccctacctctgggaagcacctgtcaggtgaattgcaggagaagctggtgcctttgccatggagctgagcatgaactacctggcccagcagacagggaattgggagaaaccggggggaagtggttgctgcaggccgggttgctctcccatgcccaggaggtgggccggcaggtcagggacagtgcacctgggctgtgaagcttgtggtgcctgcactgacattctgagcaaggtggctgctgttttcccctccaccttgcaaatctcaagaatgggtctgggccaggtgcagtggctcacacctatagtcccagctacttgggaggctgaggcaggaggatcatttgagctcaggagttccaggctccgatgaagtatgatcacaccactgcactccagcctgggcgacagagtgagaccatgtctctaaaataaataaatgaaaaggaaaaataatggttttgctaggctcttttccacactgactgatgaggccaaagaaataagtgggaagaaggagttcatggaaactgcctggctgtttctgagccactgtcccctgtcccagaggctttgcttgggcagacagagggttcatcttactgagaggtggggaaaagggcaggaaatggagagaaaggaagaacaaatccctctcatttgatcagttcatttattggatgtttcttgttagaagctgagaataaagacatgcaaaagatgcagcctgacctctggaagcagacagtatcgattatcccaggcatgtgggaggagccgggtggactctcagggtctcatcgtgctgctctcccaggtcttgccttaggcaccaccattactgcatttgagaaatggcgctggcagtagttgctcctgcttaaaatgtaagggggcggccaggcgcagtggctcatgcctgtaatcccagcactttgggaggccgaggcaggcggatcacaaggtcaggagatcaagaccatcctggctaacacggtgaaaccccgtctctactaaaaataaaaaaaataggcggggcacagtggctcacgcctgtaatcccagcactatgggaggccgagacaggtggatcacgaggtcaggagatcgagaccatcctggctaacatggtgaaacctgtctctactaaaaatacaaaaatattagccaggcgtggtggcgggcgcctgtagtcccagctactcgggaggctgaggcaggagaatggcgtgaacccaggaggcggagcttgcagtgagccgagatcgtgccactgcactccagcctgggtgacagagtgagactctgtctcaaaaaaaaaaaaaaaaaaaaaaaaaaaagtaagggggcagctcgcaccattaggatggccactatcaaaaaaaaaaaaaaaaaaaacccagaaaataagtattggtgaggatgtggaaaaatcggaacccttgtgcactgttggtaggaatgtaaaatagtgcaggcactatgtaaaacaggatggcagttcctcaaaaacttaaaaatagaattaccatatgatccaaaaattccactgttgagtatacatgccaaagaaagcagggtcttgaagtgatatttgtacactgcgttcgaagcactatcattcacattaaccaaaaagtggaagcaagccaagcatccatccacagacaagtacataaacaaaatgtggtggattcatacaatggaatagtattgaggacaacatttctactaagtgaaatgagctaatcacaaaagaacaaataccgcgttattccacttatatgaggtgcctagactcatcaaattcacaaagacagaaagtaacatggtggttgccaggggccatgcagtggggaggggatggggacacagtttcagttttgcaagatgaaaagagtcctggagatagatgatggggatggctgcacaacactgtgaatgtatttaacactactaactgtacacttaaaatggttaaaatagtttattttattttattttattttattttgagatggagtctagctctgttgcccaggctgggggcaatggcatgatctcggcttactgcaacctctgcctcccaggttcaagcaattctcctgcttcagcctcccaagtagctgggattacaggtgcccatgaccacgcccggctaatttttttgtatttttagtagagacagggtttcaccatgttgaccaggctggttttgaactcctgacctcaagtgacctgctggcctcggcctcccaaagtgctaagattacaggcgtgagccaccacgcccagccaaaatggtaaattttattatatgtgtttttcaccataacttttataaaaaacctaaggagaaatgttgaaactaccaaggagaaggtgttattgagaataaactccaacagccgagacctgttggtcctctttggtcaactggagcaggtgagaggggatgccctgacctcaagcctctcctctccaattgtttcaaggtttgcttctgtgaaaaggaaaatggaagtttacttaaaccccggcatgtgttttattttgtcctaattgtgtagccaggcattcactgttctcattagttctgccaagtcagcaccagaggctggcgaggtggccgtggagatgaacgagtccttccagatggcagagagcggtgtgaggctgaggcttgtcatagtgatatgcaatgcccctgaactctgaagctgagaacttcctttgggaagctgggtgaccatctgcgaacacttccaccccaaacatcatcatcagtggttttacgatgatgtttgagttcctagtgtagcagttaaattttacagcaaaagctataatgctcctttatactttgttaaattatctttggacaaagagttatgggagaaggtgaagaatgaagaattcctttctgaaacacaataaaaagagtggatcaatgtttttcggtagctcctggggccgtcttcccctgacaatgtttctcaacgctgaaacacacacatggtcttgcagagccagcctctgagcgaggaaaagcttggcacccccatgtcctgagtgggctcaagttcaggtttccaaggccatggtgcccaagctacaggcagccaaagtttcagatgttaccatagctaattgtaatttactcagcttcatcctcacaaagctgaggacattaacactgtagttagcaccattttccagcaggggaactggggtttagacacagagttaggttttgctcaaggtcatgcagcaagtaaacgtgaaaaatgaggtttgaacccaggcaatctgggtttagaggctgaagactttactacatgcagcttgggctctggtggcagagatgtcaacgccatcagaacaatacagaactcatgaaagctccagttccagataggatgttgaggacaccacaatgtcagaaggtgtcacactggttttgtttttaaatcaagaaggtgctaaaaggaggcaatcagataataggagaaaaaaagtcactactgggttggggcacatgcatgagcctgcagggacaggaaggagggagggtaaggtatctccaccagaccctcaactcaccctctccctcctcctgggttcaagtgattctcctgcctcagcctcccaagtagctgggattacaggcgcccaccactacgcccagctaagttttgtatttttagtagagacggtttcatcatgttggttggtcaggctggtcttgaactcctgacctcaggtgatccacctgcctcggcctcccaaagtgctgggattataggcgtgagccaccgcaccaggcttccagtcccttcttttggcctctagttataaaggtaattgtaaccatgaaatatccaggatataagttccctttgcccactggtactttcgacttggtttatccacgttttcgtgcactctgtgtcttcttagtctatatcctatgatagttattctacgattcacacaatatccattctctcatttcttacgaccaaatttaacttcaaccttttctaactttgtgataccagaaaatcaaaatgatttatctctttccttctgtctcccaataacgcgcacacatgcacgtgcgcacacacacacacacacgtacaatatagtttctagaaaatgttcatctagctcggttttctggcccttaaccgaatgtgtgagtagtgtaaggatgcattttcttgatcctgtgctatgtttaaagcaatatgtctccatctgatcagggttatgtctctctacaaatgctggatttatgtaaatgccactctgtctccaaccagtacagcacatgatttagctgtcgttcagtgatgttattttggagaactgcatgagctctaactacagaatttaagaaattctatattaaaggagaagaaccagcatcagtgctggcttttacaaaactatttatttcaaaataattggagacccacagggacttgtaaaaataagaaatagagtttgttgagccctccctcaccttacttcctccagtggtgacatcttttataactctattgcaacatgagagccaaggaccaagaaattaacactgctacattacactgcaaccttactcagttttcacttatttttaccctgcattaatttgtgtgtgtgtgtgtgtgtgtgtgtgtgtgtgtgtgtatagttttatgcaattttaccctatgtgtagatttatgtaatgtcaggatcaggatacggaaccattctatcatctctggggaactatctcatacccatcctatccaggctcacccatccacccacccgtccctaacagcaaccactaacctgttctctatctctatagttttgtcattttgaggatgttttgaaatgaacttgtacaatattttttaaaaaaaccatttcaaattggctgtttttactaagtaaaatgaatgcccttaatatccatccaagctactgcatgcatcaatagttttcattgctgagtaatattttcttttatggatgaaccagtttgttcaactcttcaccctttgaaggacatttgggttgtttccactgtttggttattatgaataaaatcgctgtgagtgtacaagtttgtgtgtgaatataactttccatttcactactgggttgtattgttagtacatgcctagtttgttgttctctttttgagatgaagtctggctctgtcgctcaggctggagtgcagtggcaccatctcggctcactgcaacctccgcctcccaggctcaagtagttctcctgcctcagcctcccgagtagctaagactacatgtacttgccaccacacctggctaatttttgtatttttagtggagacagggtttcaccatgtcggccaggctggtcttgaactctgacctcaagtgatccacccacctcagcctcccaaagtgctgggattacaggcatgagcctccacacctggttgtacatgcctagtttttaaagaaacttattttccagagtggttataccattttcacacttccactagctatgtgtgagaattccagtttctcaacatccttgccaagatttcatgttatgcctatttttatattttagctatttaaaaaacaatttttttcttttcttttttattttattttttgctctgtgcccaggctggagtgcagtggcatgatctccactcactgcaacctccgcctccctcgttcaagtgattctcctgcctcagcctcctaagtagctggaattacaggcatgtgccaccacacttggctaatttttttgtattttagtagagacagggtttcgccatgttggccaggctggtcttgaactcgtgacctatatgatcaacccacctcggcctcccaaacttagaatggtttcttcatgttgttgctagtacataaaaatacaattgatttttctgtgttgatcttgtatcttcaaactttgctatactcacttagctctaggagttttcctagatttctgatagggtttggctgtgtccccacccaaatctcaccttgaattgtaataatcccgacatgtcaaaggcagggccaagtggagacaattgaatcatgggggcggtttcccccatactgttcttgtggtagtgaataagtctcatgagatttgacggttttataaatgggagctcccctgcacaagctctcttgcctgcctccatgtaggatgtgactttgctcatttgccttctgccacaattgcgaggcctcccagccatgtggaactgtgagttcattaaacctctttccattataaattacccaatcttgagtatgtctttattagcagcaggagaacagactaatacagtatcttacttagcattttttacctaatcaggtcatctgaaaatatggacagttttatttcttcctttttgagctgtatgctttttattttcttttcttgccttattttactgactgaaaacttgacaggacacatccttatcttgttccatatcttacaagaaaaacgtgagctttcaccattgagatgatgtcaactgtaggattttctgtagatgatcttactcaagtttaggaggttccccttcatacctagtttgctgagggtttttatcataaaatgataaagacaaataaaacaaatacaataaaaaaacaaataaaaataaactgtctttattgttgccagtcttgagataattttgtcatttttactgatattttcaaagagccagctttttctttgatttctgctcttctctttgttattttttccttcttttcctggtttcctggggtgggtgcttaatttttgaccttaggatctttcttctttcctaatataagcatttggtgctgtaaatttccctctgtgcagtgctttagctgcatgtcacaaatttcgatgtgatgtgttttcgtttcatgcagctatgggcacttttatttttctaactgactttttaagccattttaaagtatacaattcagtggtattagtgcattcaaaatgtcatgttaggccaggcgtggtggctcacgcctgtaatcccagcactttgggaggccgaggtgggtggatcacgaggtcaagacatcaagaccatcctgggcaacatggtgaaacttcgtctctactaaaaatacaaaaattagccagccatggtggtgcatgcctgtagtcccagctactcgggaggctgaggcaggagaattgcttgaacctgagaggcggaggttgcagtgagccaagatctcaccactgcactccagcctggtgacagagcaagactccatctaaaaaaaaaaaaaaaaaaaagtcatgttaccattaccagtatccatctccagaatttttttcattatctcaaactgaaactctatccattaaatggtaagtccttattccccgttttgctagttcctggtaacctctattctactgtctgtctatacatttgccagtcctaggtgcttcatacaagtgaaatcatacactttgcctttttgagtctggcttatttcactttgcacatgttttcaaggttcatcacatgtggtagcatatgtcaaaatttccttcttttttaagactggataataattcagttcatcgtatgtatgtgccatatttcatttattcatccatccattggtgggctcttgggttcttttcacctattgtgaataatgctgctgtgaacagcaatgaacaactacctatatttctgctttccattccgtgtaagtatatacccagaagttagatgactggattgtaaggtaattctatgtttaactttttgcacaactcaaactgttttccacagtgactgcatcattttacattcctaccagcagtgcacaagggttaaatttcttcacatcctcaccaacacttgtcattttcaatttgggaggataataagtcatcctaatgggtatgaagtaatattacattttgatctgcatttctctagtaataatgtttaacatctttgatgtgtttattggccatttgtacagctcctttggagaaatgtctattcatgtcctttgcccatttttaaattgagttgcttgtggtttgttactattgttgttgagttgtaggagttctttatatattcaggaaattattctatgtgatcttactctctttacatttgtgaaggtttgttttttatgatccaggttttcatctatcttaaatgttccacggtgcttgaaaagaatgtatactatgctgttgtcacttagaatattctatcgatgtccattagatcatgttgattgatggtgatgttcagttcatctgtatctttgctgattttctatctaatatttctatcaattgctgacagaggggaattcaagtacccaaccataattggggaatcgtctagttcttttttcagttctgtttttacttcatgcattttgatgttctgtcctttggtgtttggtacatgcacatttaagatcactgtgtgtttttggatggttgcatctttatttatttatttaagacagatcctcactctgtcatccaggctggagtgcagtggcaccatcttgactcactgcaacctctacctcctgggtttgagtgattctcctgcctcagcctcccaagtagctgggattacaagtgggcgccaacacacccggctaatttttgtaattttagtagagacagcatttcaccgtgttggccaggctggtcttgaactcctgacctcaagtgctctacccgcctcggcctcccagagtgctgggattagatgtgtaatccactatgcccggccaggttgcatctttttatcattatgtaatgtccctggtaattttctcttggaagtctactatatctgttatgaagccactccagttggcatggcatatcttttccatccttttatattcaatctacttatgtcattatagtgagtttcttaggtgcatcacatagatgggtcattttttaatccattcttccaatctctgtttttcagttcgtcactaattatattttacagagatcatttatattaaaaataattattaatcgattagggctcaagtctaccattttattattgatctcctgtgtgttgtctccagttcttgttcctttgtgtacctcttcttgatttcttgtggattacctgaatgttatttagaatttcattttgatttgttcataatgttttttattcatttgaataattttcttagtgtttgctctaggtataccaaaatatatgaagcatatcgcagtctactagtattgacatttaccatagtcaagtgtagaaactttacttccctttatttccctttgccctctccaatttttaaatatcgttttaagtacttctatatacactgagtaccataccagatggcattataatgtttgttttaaccatcaaatataattgcataaggagaaggatagtctattacgtttgccctttttacttattctattgtttttttctttcattctgtatttcctttcctctttctgtcatctccatctgctatcacttgcattttgtttctttagctgttctttaaaagtagatttggctgggcatggtggctcatgcctgtaatcccagcacttcaggaggccaaagcaggtggatcacttggggccaggaattcgagaccagcctggccaacatggtgaaaccccatctctactaaaaatacaaaaattggcggggcatggtagtgcacacctgtaatcccagctactcgggaggctgaggcagcagaacgcttgaacccaggaggcggagggtgcagtgagccgagagcatgccaccgcactccggcccgggtgacacaatgagaccctgtctcaaaaattaaaataaataaataaataaaatttttaaaaagagtaaatctgatggcaacaaattctattcctttgtctgcgaatgtctttatccttcagaaataaatggtactttcactagttttaggacatagggtttataattctttatttttcagcccttgaaaaatgctgggctacttcctcctggtctccatggtttcagatgatgaacattctgtcattcaaatcattgttcccctgtaactaattcatcgtttctttctagctgctttcaattgtgttttttggggatttttgtcttcagttttcagaagttttattataatgtatcttgatgtggattcttttggttttattctgtttgagattcacttagctttttgaatctaagtttatgccttgcaccaaagttggggaattttcagccattatttcttctggcgccttttcagcttcacaaattttctcctatcctggaactctgatgacataaacgctagttcttttgtcattgtcctgcaggttatgagactttgttcatttttttcccccaggctattttctctatttatttatttacttagtttttgagacacagtcttgctctgtcacccaggctggagtgcagtggcatgatctcagctcactgctacctccacctcccgggttcaagtgattctcctgcctcagcctcccgagtagttgggattacaggtgctcaccaccacgctaatttttgtatttttagtacagacgggatttcaccatgttggccaggctgatctcgaactcctcacttcaggtgatcccccgcctcggcctctcaaaatggtggcattacaggcataagcctgtattatttagattgagtaaattttatttctctattctcacattcactaattttattctccgtcatctctaagctagtacggagctcattcagcaaactgtttctttcagttcctgtatttttagttctatgattttcatttagttccttttttacatcttctatttctttgctgagactttctatgtttacttgtttcaggagtatttgtaattgcttgttgaaactttttgtgatggcggctttgaaatcttcatcagcaaatttcaactgctgaatcatcttcatgtgtgcttttgtttgtggtctgtggccattcaagttattttctgggttcctggcatgacaagcggtctttgattgtatcttggagactttgggtactatgttagaagactcagggtctgtcttctttaaagtttccattttagcaggcagtttccccgtttagacttaggatgcaagtcccttaggctgcgggtccaatgacgactgagttttcagagcccctgtagtgctactgtagtcaagtttgttagtgtgccacctgcggggcactctgcaatgcgtatgtacatctgcatgtgtgaaactttcacactggtccagttctaatcttttgatgtgttgaactggtcagtttttacctttgggttgatcagctgtctgcgccagaccttctaggcagggcttaaagaatcattttctccagctttttcctatctgagatcctcttccccatgtctagctgggggtggggacagaagtccagactccccactccatctctgtggacaccatgccagtagggaaggaacttgctgccaacagctgccaacaacttgctgccaacagctgccacctggccctggtggatgggagtgggagtccacaccccctccctggcctctgctgatggcaccagcccaggctgcctgctgctgctgggcggggcataggagtctagactctcctttgagacttcactgcagtgctggagttgctaaggtgtgcacttagctggaggtaaagtggatattatcaaaaaggacttccgtcctgtgggctgcccatttccctgtctctgctagataaataaggtttttcttcaagctttattttccatctgtgccttatggtggttctggattgcaggcttctctagcacccagtccagaatatagcaaagataaaaagaaaacccagagtgtcgccaccacctcagtcctcaagtcttgagttctcgaaccaggctgcctgcctctttttacttttccaagggtccttatgattatccattaaattatttccagggtttttagttttacttaacaaaaaggagcagagggaagtgaatctacttgtctaggaccagaaagccagctgcttttttatgctgtcttttattttgtagctagaaactcctggatttttttcctcagaatgttggagtcaatgtttcttttattttcaaatacagaaatgtcttataacctgtttactaaaatgataaagaatcaggttaacagaggccaggcacggtggctcatgcctgtaatcccaacactttgggaagctgaggcaggtggatcacctcacatcaggagttcaagaccagcctggtcaacatggcaaaactctgtttctactaaaaaaaatgcaaaaattagctaggcatggtggtaggcacctgtaatcccagctactcacaaggctgaagcagggagaattgcttcaacccaggaggcagaggttgcagtgagccgagatcccaccactgcactccagcctgggcaggtcccaagagcaagccgcaaaggtccctggcaagtctcagcccgtggctggatcctccctctgctgcctctacctgttggttttacatcaggtttcccacctggtttcttcctggaagcccagtcttgcagggggtacaggtgattttggacggtaatgcagagagaccagccactctccactgtgagacaagttgcatgaggatgaggcttcagaggtctggcctgaccttgattcaggtgcgatgtcaggaaggaaacaaacgttggcattaggattgcatccagcatgaatgaattgtgattgctgaatgagtaaacttttagttggaggaacatttccactccaaactcccgtgggagtaagttcttcagaaactgccttcagtgtgccccaggattctgtgaaagtgcagagactggcaccaccaactgtcagccttctccagggcaggatgacaacatgtgtcaggtcccactgaattgcccaaaaggctgaataagcacatgtaccagctttccaaggtccccgaggcttcagggagagggaggggttggaggaaatattgattccaacttttgaaagaaaagaaaatcaacattaacatccatagatctataagatgtattttatgtcaaataatccattgtaattcaatttacatgtaggaatataaaattgcatttgatgttggggggggcgggcattgaaatgtatttggtatgacatggagtggagccttcagtgtttttaaaagggcccagctgaaccaggaaaggagggacaaaaatagaagggtggggagggaaaagatcagcttcaatcagttcatgcacaattttgcaatcagaaatgtcagaaggaaactattttagtgtccacacacttaagttttgtgaaatggggtgagggggccgggcacggtggctcacgcctgtaatcccagcactttgggaggccgatgtgggaggatcacctgagctcgggagttcaacaccagcctggccaaaatggtgaaactgtctctactaaaaatacaagaattcactgggcgtggtgacgggtgcctgtaatcccagctactcgggaggctgaggcgagagaatcgcttgaacccgggaggcgaaggttgcagtgagtcgagatcgtgcctctgcactccagcctgggtggagacttcatctcaaaaaaaagaaaaagaaaaaacggggtgggggtttcatgaggggctcactgctcggggtcttacctgggttctgccagtggtggggctgttactttccactggcagccacaccaagctggccacacctggcacctctggtgtggtggctggggatgccctggagacgaggtcttcagatgccccttcatgtgcaccagatgccaagtgcctgctgtaggggagggtggcggagaccctaaggttcggtgtgcaggaggattagccggtttgccagacaagcttagagcatgtctttaccccacttgccctgtggggtaagggtaagaactgtcaccctttggtgctggctcctgtgccaggaccccctcccaggacaagtgcacacgatcccctcccagcagagcttggatatagccctgcaacttgcagtaggctccgcccacctcttccctacaacccccactcctgtttggggctgtaaaagtagaaaaaaactcccataaaacccaaaatgctttttctactctcaccccacaaaaatcaacacagaagacttctatggccaaatgtgcagggatttctccccaaaaataaacaagcaatcggttctgcagtggacaccagctgggtatcccccaattcagttccaatactgtctacctggagagagtatcagatcccagagggtgagggctctgtgcccaagactaccccccttcccagccccgctagataccagcaacaagtccggggcctccagaactcctgcctgactggcttcaagttggggtccccatggctcctcttttggtttgattaatttgctggagcagctcacataactcaggggaacacttaacttacctttagtggctgatcacaaaggacacaaatgaagagatgcacagggtgaggcatggaagagggagcacgaagcttctacgccctccccagggaccaccctccaagaagctccccgtgttcagccatccaaaagctcctgccatccagcctcccgagtagctgggactacaggcgcctgccaccacacccggctattctttgtatttttagtagagacggggtttcaccgtgttagccaggatggtctcaatctcctgacctcatgatctgcccgcctcggcctcccaaagtgctggtattacaggcatgagccaccgcacccggcctccttagggtttttatggaagcttcatgactgattaaaccactggccattggtgatcaactcaacctccacgttggggggttgggctgaaagtcctaaccctctaatcctgcctaggtgttgctcgtaaccagccccaaccttcctaggtgctgccagccagcagtcagttcattcatgtgcaaaaagacatcactgtgtagttgctaaggatttcaagagtcatgtgccaggaaacggggttcacaatatcacaggggccatgctgggtctcccatgagcctgagacacccagcctcgtccatagtgtgctcaggagtcctgcactgtagggcgggatgtgcaccccgtgcatgggacaggggacacagaggacacagaggagctcggaagtgtggcaggactaggccacgatgacccattctcctgccaaggaatagcgagagaaggctccccagggtgcagccacagcacacctagggggtccacggaaacagaccccgtgtaggcctctccctgtgagttcaggtcatctgagactgatcattcaagccccagccatgcgctgttgatgatgtgagaccacagcttatccaggaatcaaaacagaggtgtctgctccagccacctgtgatttatgggctttaattgcagacctgctcctgtcttataaaatcaggatggagcctccactgctgaggcaaggaaaagatttgtctaaaatattggctgctgtcgtcgatactgggacctcttgagccaggtcccttccacattctgatgaggtaaggctgctctggaagaaaaagccctccagaacataaatctatttgacaacaaatgtctccttctcatggcgagccaaatccccctgtgcaggagccagagatacagacacagaaaaagaggagctggttcagtcttcaaggacagaaagaaagagaaactctgcctggtgctaaagcaggccctctttgcagctcattccaagcctaaaccagctcctgcaactctcaccaaagctgtagctcttcacggggatggaaaagcaatctcgtcgcgtgtggccattgggatgattttctcctcccctcatgcctgctgtggacgaggggcgtttcctcacgtcgcaactgttgctttggccaatggaacgttagcagttgaggtgtgggcaaagtcctggaatgtgcttgtgcgtacagttggctcagctcctgggctctggcccttcaccatgagaacacgtccaggtgctgctgatcaaaggaggaggaacccgtggggcacatcagaggccgccctgcagcttagagcccagtgcagctgagcccagtggcctgcacagctgtgcatgaagaatgaacattggttgctacaagccactgaaattgtgaagttgtctgctacacagcaatattatgccagtagtccatcaccacatccaggactttagagaagcaagaccctgatacgacgctcctgccaccatctcagaattatctgaaaaacaaccctgacaccaacataattttttctctctcacaaattcaaattatattattccctcagtctgtgagtcaggggttattttatttttaaagtttgctgcctcctcagtatatgtaatttgaccctaattttgtaagacatgaatatagctaaatatattccagagatgagactgaaatgctcaagatggtgacagcagtatttctgggttgagagatttagagtgacttatgttccaccaaaaacatttctatatttgttcacattttctataatgtcattattttatgatcaactatatatacttgatttttgaacagataaagcttaacataaacatggtttaaacataaagtttactccccagaaactttgttcagaatgtcaaaaacacaggacaggaagataagtaaatcctcatacagcagagtcactgttcaccctgggaagggaggtaactgccagaaacccaaacaaagggatcctcagatgctgttggcctcttctgcttaggaactgatgtcagaaaatatttgtccttgagaaagccagcccctgattaaatgttactatgctctgatacaatgtcagtaaatcatttccaaaaccccaaacactgaaatagtagggggtggcaatgaccacttgggtgatttctcacctgggaggacatcataaaggtaaagatgagcactggggtacaaatgtgcttgcaatggggacatatgcagtgagcagagagtggggcacacacctccctagactcatttctcagaaacacatcaggtcacccactttctctccaaaagcagaagtcagattgagctcatgttcccttgtccatgaataactggatgtgtgaggttatgacagatttagaacctgccaaaatcagagtgagtgagagagtgagtgtccttcctgggctagaacatactctacttctctgaagttgaacaagatggaaatttcataacctcaagggacagagagaacactgcccactgcagatggtaatattcaggggcatcctccagggttcctcaggtgggcagaaccagaatgggtcatgggatgagagatctattacgggaacgagaccttgccagttgcaggaggagctagagaagagaaggtatgagagggaagtgtgcagagcggaggagtcaccaactagctggtctgagaaatcaagctcgtcgcactgccaacgctggtccatgaaagcagaggagacatctacagcaagctatttcttcagccaagcacctgaagatggtcggagttattgttggccaggaggatgccccacagtgaagaagaccaaatggacatggagtacaaggacacgcaggaggctgtggcacctccaagtgtgtctgtcactgcacctaactgcgttgaccttcagagggtaatggctgctgcctgctgatcagaattggctcagtcctttctgcaaggaaggaaggggaaagggaaatcaaaaggaatctggccttgtcagtttctatggcgaggctctgccagcaaaaaacagtggctatgggccaggcagcccagagtgcctgctgcagggccagctcttccagctaagggcttctccacctcggcactgctgatgtttccagcccagtgatccttggtggtgggggtttatcctgaacaccactggtctctatccacaggattccaagggcatagtccctgcaagtcataaccaaaaccatctccagacattgccaaatgtccccagagtggtggcagacaaaaccctgccagctgagaaccactgttttaccttctgcatctcagagtgctgaatcaaggtttaagaacataatgaagcttattcagtcacattgtgctcactaaaaacattgttttaaaaagttttagtgagaatagaaaggatttctgtgcaattaataaaaaacaaagggctgggtgtggtggttcacacctgtaatcccagcagtttaggaggctgaagcaggaggatcccttcaggccaggagtttgagactagcctaggtaacatagcaagaccccatctctacaaaagtttaaaaattagccgggcgtggctgttgcctagcaagtaaataaatccagtgttctatttttctatcactgtggcattcattgcctttcctttaacaattctggagattccactaagattgccttgtcgattctccttgtctggagcagtggacagcccaatctgaggagtgtgagccctcagctcaaagggctgagcccacggtcaggggctctgctgctttttgtggtgagtcactcaacagcaataatgcctttcttgtttgtggagttataacctgaatcctggtcagcagtttccaatgcatgactcagtgtgagactttgttgggatgctaaagtgatttgttgagttttcaaccttgatttgtaacttatctattaactctcttttgaaagaaatctttgtcgtggaggagtaaataagctactgagcatctgcagagtcccacggctctctaaatttctgcctattccatttatagtctgcacttcttgttcaaatgcatgttgggtcgtggagaccaatgctgtccagaaaaaaactggccgagtcttgactcaatctgaaagtctctctgttacacaaaattgtcatttgccatacttatcataattatctgtcggtttgtctctctgtttcttgtcctaaaagttctgccgaaagtttgtgattgaagcatttatgcaaaagtcagacgtaacaattaaaatggtaaattttatgttacatatattttatcacaataaaaaataagtcaaatgctggctgtacaaactaaaagtaaagagtgagacatagacttacgggaggcagctagagcagttcttacagataaatttataattgtaaatacttataataacaaagaaaaaagatctcaaatcaacaacttaaccttccacagtaagacactgtgaaagaacagcaagctaaacccaaagcaagcataagaaaggaaataagaagaattagagaggaatttaatgaaataacaattagaaaaacaatagagaaaatcaacaaaatcaaaagttggtttttgtttgctttttttttttttttttgagacgaagtctcactcttgtcacccaggctggagtgcaatggcataatctcggctcactgcaacctctacctcccaggttcaagcgattctcctgcctcagcctcctgagtagctgggattacaggtgcgcaccaccacgcccagctaatttttgtatttttagtagagatggggtttcaccacgttggccaggctggtcatgaactcctgacgtcaggcagtctgcccgccttggcctcccaaagtgctgtgattacaggtgtgagccaccacgcccagccagaagttggttcttgtaaaagatcaacaaagttggccaacctttacctaggctgactgacagaaaagagagagaaatcaaattactaaaatcagaaatgaatgagaagccattgccaccaacttacagaaataaaaaagaattgtgaggaaatactatggacatctgtatgccaacaaattagatgacttaggtgaaatggacaaattcctagaaagacacaaactccaaaactgattctagggaaacatagaagatataaatagtcatagaaaagagattgaattagtaataaaagaaaaaatctaggccaggtacagtggtataagcttgtaatcccagcactttggaaggctgaggtgggtggatggtctgagctcagaagtttgagactagcctgggcaacatggtgaaaccccatctctacaaatacaaaaaataaaaattagccaggttcagtggtgtgtgcctgtagacccagctactctgggagatggaggtggaaagattgcttgagcccaggaggtcaaggctgcagtgagactgcactccagtctgggcaacagagtgagggcctgtctcaaacaaaacaaaacaaaacaaaacaaaaaaaccaaaaagaaaagaaaagaaaaaagattcccacaaagaaaagcacagcactgaggaattctaccaaacatttactaaagaattatactgatctttcacaaaatcttccaaaaaatacaacagaagccaacactttccaactcttcctatgagcctgataatagcccaataccaaaaacaaagatatcacaagaagagaaaactacagaccagtatctcttatgagtacagatgcaaaaattctgaacaaattactaccaaattgaatccagcaatgtgtaaaaaggatttacaccataatcaagtgggatttatcccaggaatggaaagttggcttaatatctaacaatagattattttaatacaccatgcctttacaataaaggaaaaaacacacaacaatcttaatagatgcaaaaaagcacttggtaaaatttaatactctttcataatttaaaaaagtcacttttaaaaactagcaatagaagttcctaagcctgataaaaagcatctatgaaaaacttacagctaatatcatacttagtagagagactgcctacttttcccctaagatcaagatgtctgttcttgccacctctactcaatattataccggaagttctagccagcgaaattaggcaagaaaatgaaacaaaagtcatcaaaattggaaaggaaaaaataaaaccatcactatttgtagattatctaatcctgtctttacaaaatcctaaggggtctaagaaaaaaattaatattagaactaataaatgagttcagccaagtttcaggatacaagatcaatatcaaaaaatcagttgtatttctatacattagcatgcacaatcaaaaaatgaaagtagaaaaacaggctgggcacggtggctcacgcctgtaatcccagcactttgcaaggctaaggtgggcagatcacttgaggtcaggagttccacatcagcctggccaacatggtgaaaccctgtctctaaaaaaagcacaaaaattagccgggcatggtggtgcgcacctgtagtcccagctactcagaaggctgaggcacaagaatctcttgaacacgggaggcagaggttggagtgagccaagattgcgccactgcactccaccctgggcaacagagtaagactctgtctcaaaaaaaaaaaaaaaaagaaagaaattagaaaaacaaattcatttacgagatcattaaaaggaataaaatacctaggagtaaatttgacaaaagaagtgcataacttatgctctgaataccacaaaatgttgttgaaagagattaaagaaactctaaatatatgcaaaaacatatcccatgttcatgtattcaaagacttaataatgttaacatggcaatattacccaaattgatctacaaaattaaagcaattcctatcaaaatcccagctgacttatttgcaaaaattgacaagctgattctaaaattcatataggaactcatggacccaaaatagtaaaaaagaaaacattttggaaaagaagaacaaatctgtagcacttaaaattcccaatttcataacttaatgcaaagttaacaataatcaagacagcgtggtattggcataaggatagatatatagatcagtggaatagaattaagaatctagaaatgaacctgtgcatctctatattcaactgattttcattaatggtgccaaaaccattcaataggggggagagaataatcttttcaactgggtgtggggaataacaattatatatatacatatatatatacacacacacatatatatactgtatatacacatatatacatatatacacatatatatcatatatacatatatacacatatatatcatatgtacatatatacacatatatatactatatactatatatatactatatatatagtgtatatgtatacatacatacatactatatatttttttgagacggtgttttgctctgtccccaggctgaagtgcagtggcacgatctcggctcactgcaacctctgcctcccaggttcaagcgattcttctgcctcagactgccaagtagctgggactgtaggcacacgccacgacacacggctaattttttgtatttttagtagagatgggatttcaccatgctggccaggatgatctcgatctcttgaccttgtgatccacccgccttggcctcccaaagtgcagggattacaggcatgagccatcgcgcctggccaataatattcttttcaacaaatggtgctgggacaactggatgtctacatgcaaaagaattaaattgaacccctacctcattccacatgcaaaactgaaaggcaagtaaaaacgaattaaagacctaaacgtaagagctaaaactacggaattcttagaagaacacatagacttaaatcttcacaaccttggattaagcaacattttcttagagatgacaccaaaagcacaagaagcaaaaccaaaagtagataaattggacttcactaaaactaaaatttctgtatttcaaaggacaacattaaggtagttaaaatacaagcacagaatgggagaaaatatttgcaaattatcctatcaactcaacaataaaaacacaaataacacgactgaaaagtggacaaaggattagaatagatagacatttctcccactatacaaatggaccaataagcacacaaaaagatgttcaacatcattagccaccagggaaatgcaaatctaaaccacatgagacggcacttcacatccaacagaaaatctagactcgaaaatacaagtgataacaagcatcaaaaaagacatgaagaggctgggcacagtggctcacgcctgtaatcccagcactttgggaggcggaagcaggtggatcatgaggtcaggagattgagaccatcctggctaacacggtgaaaccccatctctactgaaaatacaaaaaattagccgggcatggtggtgagcacctgagtcccagctactctggaggctgaggcaggagaatgatgggaacctgggaggcggagcttgcagtgagccaagatggggccactgcactccagcctgggtgacggagcgagactctgtctcaaaaaaaaaaaaaaaaaagaaagaaagaaaaagacttgaaggaattgtaactctcatacactactgatgagaatgtaaattggtacagtcactttggagaacagactggccattcctcaaatggttaccatataccccagtaattccatttgtaggcgtatactgaatataaataaaaacatatgcctgcataaaagcttgtacgtgaatgttcaaagcagcattattcataatatccaaaaagtggaaacaacccaaatgtccaccaactgatgtatgaataaaataaaatgtggtatacattttactggatatcatttgtcaagaagaataaatgaactgatacatgcttcagcaggaatgaaccctggaaacagcatgctaagtgaaggaaactcgttccaaaagaccatatgttctatgattttacttttgtgatgtgtccagaaccggcaggtctttacagatagaaagtagattaccggttgccaagggctgatgggacaatgacaaaggggtgcagagttcctcttgggaaaataaaaacgttctaaaatggattatgtgataaccctatgaatatatactaaaggccatttaattgtgcactttacatgggcagattgccagtatataaatgatatctcaataaagccggttatcgaaaggagtcatatagagacagggaagtaaacgctcaaagggttctgcctgaattcatcatcacagaagtgagtcctggccgggcgcggtggcccacgcctgtaatcctagcactttgggaggccgaggcgggtggattgcctgagctcaggagtttaagaccagcctgggcaacatggtgaaaccccgtctctactaacatacaaaaaattagccaggcatggcagcatgcacctgtagtcccagctactcgggaagctgaggtaggagaattgcttgaaccggggaggtggaggttgcagtgagctgagatcatgccactgccctccagcctgggcaacagagcgagactccaagactccatctccataaaaaaaaaaaaaagaaaaaaaaagaaagaaaagaaaaagaaaagtaaagaagaaaaataaaaaaaagaagtgggtcccaaagttactaacccagtcagaagaaattgggatcagccaggcatggtagctcatgcttgtaatcccataattccagctctttgggaggccaaggcaagaagattgcttgagcccaggaattaaagaccagactgggaaacacggcaaggtgccatctctgaaaaaagagaaataaattgagttcattgggagaccacaaacttaagaggaacaccaaatacacactatagcaggacattatcagagaattcttagaaatggagcatatggaaaagaaaagaaatccatggccctccaatctgcagagctcactccaaaccttaaagccagggatgatgagacgtgagaattctgtttctcagttaacctagaattaagtctaaatggtgaaaaaaaatagatgtagatcctgccaacagcagggactttggaaaaatgtgtccagcatcaaaggaggactcaaaggcaaaagcattttgaaaagaaaaggcaaagcatgcaaggcagtcagacatcaggagcatttacccaccaaatcagaaagcacgaatgttgaaaaccgcagcaatgatgcctccctgcaacctcaccaaagttgccacattacagtagcttgttcatggtggggaaccagtcgtttttctcatgtgattaccttatttatttatttatttatttattttgagacagagtctcgctctgtcacccaggctgcagtgcagtggtgtggtctcggctcactacaagctctgcctcccagggttcacgccattctcctgcctcagcttcccaagtagctgggactacaggtgcccgccaccatacccagctacttttttgtatttttttagtagagacagggtttcaccatgttagccagaatggtctcaatctcctgacctcgtgatccgcccactcagcctcccaaagtgctgggattacaggcgtgagccactgcgcctggccgtgattaccatatttctgaaagacataatacttttgtgggaaatgctcagtattttattgattctgggtactagaataagacatgatttatttcagagtgaaatatgtgaggtttttcctgactgtggcaggtcacactggaagcagggcaaatgtcagatttatgtttttggtcttgtcttgaaagtaaaaggccagttgtagtcaacagagctcttgctggcataattccaaaggccataagagtgcttggctatgtcttctgttctctgattcagaagaaaagaaatcattgattgtgttagctttctattgatgcctaacaaattacctcaaaattagcagcttaaaacagcacccgttgatcacctcaccattctggaggtcagaagtccaggtggcttgactggcttctctgctcaaggtctcacaaagctgatattgaggtgtgggccaggctgggtttttatctgaaggctcgaggaataacccatttcgtgcttactcgggatgccggcacagttccgttccatacagttgtaggactggggagcttgtttcctttctggttgtcagctaggggtgaagagccactgtccttctctacgtgaggccctctgtgtcttcaaaccagtgatggcacttcagttccttcttgtggttgggctctttctccttctgccttctcttctacctgcctcttctcccatcagctggggaaagtcctctacatttaaggactcgtgtaattagattaggctcacacagataatctcacaggttaatctctgaatcttaagttcagctgacttgggaacttaattataactgcaaaatcccttgttggcagtacctagatgaacatttgatggaataaccagggatggaaatcttggggcatggaggcacttttaggacatggcctaccatatctatagacataaagagacacaaaggcctatttctagttgacacaagggccactctgtctatcctgaaccctactgcaataaaacaatcactcactcagagaaatcaatgggttactacagtgggtatttcaaacccacttctctatccattgccttgaccaccatatgaggaccaacagaagacaacattgatttctcctccgtggtttcatgcctctccacccacctggaacaggccctttatataaatgcagctgtcatattaagtgcccacctgcaagaaccacccaatttcacagcatgctatttctacacttgactttcctaaacttgcctagaccatgactcttgaaactgtagataacttactctggctggtacattgcaatttatgagcaaaagctctgttaatggaggacatacaataggaacagagcctaaaaacacacaggtagatcctctcaagtccttgcctaagccactctaatgtcctctgaaagcagaagttattcaaggaataaaaccaattatacattctcaaatcaaaagtgtctcacagaagtctatgtatcgcctttttacaaacctaatggaaagggatgggatgttcatttgttcaagacttaagaaacattcctaaagttatccctaggtttcccgcagtgccccactctaatgctattctatctccagtttcacttacaggcaaatgtactgtaatgtacagtacaggcaaatgtactgtgagagacctttctcagccttctttggcatatctgtaaatatagtcgataggtattttctttatttagaatgactaacagtatacaggtatttgggcagtaatacctcagagacaccttatattccttccagtctttaaatcatgatttaaaggacatactcccaaaagggtacaatttcattcaatatagaagactttgcctcatatatacctctcccggaaaaccctccagaggactcaatccaccttttaaaggagcaagtggctacatatgataaagcctcaaaggaaaaatgaccattttgccaagaggtgggacatgatttaggaggtgacctctccaccaacaggcacactctacccaaaaattggacactcataggatttgggaaacttaagaggtatgaaaagcaatggattcccagtttttccagcgtaacttgactcctccatgaacttaacaaaaacacgcaaccagaaaacttccttgatgaaactgaccttgtcactttgaaatctaaatcacaacaggccccaataccggctccacctgaacatcatcatcatttaccttacgcccatttggcacatttcctttagctgaagcaaaaaggaggtgccatggggtaccaaaaagaggctttagctcaacaacatgggaagtaccagaaaccgctcctgatttaggcacttctctagactcagtggctagggttttcttccttgttatgtgccttaacagtggttgcaaaacggtcagtgcttctgtagatattatccttgtcgcaccattaactccatgggttgcccaggctgttcagtccatactactgacaagcaacagccagcactgctctgcaagcccattagctcaggctggctgctgttgttggtctctcatgttacccaccatgtgtcagtgttatcatctcagtcttgcagtattgcttccaccacctgaagaagagccccaggactatagtacagcaaacatgaagtcgagtatttccaaggaagatctagttgatgttctcctagagaatctgcagcaagtgttgcttttaaatgatcaaggtcaataccattgaagttacgcaatgattacataaaactgtattagggccgggcacagtggctcatgcctgtaatcccagtactttgggaggctgaggcaggcagatcacctgaggtcaggagttcaagaccagcctggccaacatggcgaaaccccatctctactaaaaatacaaaaaattatctgggcgtggtggcatgtgcctgtcatcccagctacttgggaggctgaggcaggagaattgcttgaactagggaggcggaagttgcagtgagccaagactgtgccattgtactccagcctgggcaacaagagcgaaaactctaaaaaaaaaaaacaacaacaaaaaaaactgtactagatgataacctttcacccaaagttgagccatctcaaatagtagaactagtagcccttaccagagctgatgccaaaagggacacatgtacacacacacacacacacacacacacacacacacagctattatgccttggtgttgtatataatttggtgatgctatgggactgaaggaatagctgacctcatcagagaggcctaaaaaaagggagaaaaaagtagatttgttagaagcactgatgctctcaaaagaggcatacaattaaaagttaaggcacatagtacaagccataataaagaaggtgatgggagtgcattggcagatattaaacaaaggaagtgcacttttctccttgttcttaggagttatttatgatgaaggaaatgtaaaaacatgaatagatttttttacatacaatttatttcagacagagtatttagccctagattcaagaaacagaaacactgggccaggcgcgatggctcacacccataatctcagcaccttgagaggctgaggtgggtagatcacctgaggtcaggagtttgagaccagcctggccaacatggtgaaaccctgtctctactaaaaatacaaaaactagccaggcgtggtgatgtgtgcctgtaatcccagctacttggaggctgaggcaggagaatcgactgaacctgggagatggaagttgcagtgagcaagatcgagccactgctctccagcctgagtgacagagcaagactccatctcaacaacaacaaaaaaaaaaaaaaaaaagaaagaaagaaagaaaaaagaaagaaaagaaaatagaaatgctggctaaaatcaggttgttctgtcaatttcagtggtctctaatggagcaaggatggcctcttgcttacaccaaaaatctgaggtagaaattgaccaaaatgcacaacagagcttctaccacggataagagttggtggggacatttccccttggtaactagagatgtgaaaggtatatgcctcatctgtactatcataaccacccccacaaaaaaattgtgatggtgggacacaggtctgagctatatcccagaggacttttaaacacttgaaaatgggctttatccactttcccaagtcacgagattatgcatatgcgctaaaggttgcctgtaaattctctggaggtgagctcttctcaagtagaaaagccactgcaataactaaacttaaaaaaaaaaaaagttagacaatggtttttcccacctgggaagccaatcatactcactaatattaaaggtactcatttactggagcagtcataaagggacttggtgaggtgttactacttcgtcaaaaatctaggccacacgcggtggctcacacctgtgatcccaacactttgggaggctgaggtgggtggatcacctgagatcaggagttcaagaccagcctggacaatatggtgaaaccccatgtctactaaaaatacaaaaattagccaggcgtggtggtacacacctatagtcccagctactcaggaggctgagacaggagaatcacttgaacctgggaggcggaggctgcagtgagccaagatcacgccattgcagtccagcctgggtaacagagtgagactccatctcaaaaaaaacaaaaaacaaaaaaaaaaaattcttgttacccttactcttcagtttccagaaaaggtagaggtacaaatgtaggtacacaacttaaattggtggtgatgtgcgcctatgatcccagctactcgggagcttttcatttttctttcttattgcttcttgctttctgtactgcttctgaggcaggaggattgcttgagaccaggagttcaagagcagcctgagcaacatagcaagaccctgtttccaaaaaaataaaatgaagtacaatacattagccagggatgatatgcacctgtagtcctaactacttgggaggctcaggtgggaggattgcttgagcccaggagtttgagactgcagtcagctatgattgcactactgcatgccagcctgggcaacagatagagacctctgtctctaaaacataaaaataataaaactggttaagttatctgaagctcttaaacatccatggctgagaattttacctctagtggccatcaggtcagcctgttctggaacttacagattgtaaccttatgaattaacaactagaagacccatgcactggtaagttttaccactcgtaattgattggagcttgcttcaggcagacctagctaaatactgtcaaagagaaattcaataatcattcttatcttccatgattgcaaactagattttcaaaaacttcaccttcaaaacctctacactccttcaacctagatattaggtattctggaaaagacaccaattggaaatattctctagagacattctggaaaggatcctaggaaggtgatagcagaagcggcccatctagaatggcagctgccaagatgccagctgcagcagacaggcaggcctgggcctcccattctcagagtgggctgaagccccgccctccctgggtacctctgcagctgccctcccaggcgcaagacccgggcatctctgcagtctgcacccttgggggcctgggaaggccccccatctccacaggctcaggagtctctgctctgctgcctggcctcttcccagctcagcaccctctctgatcttgaagcatggttggggccaagcccaggcactgtcacagcccagctgggtgtatacacactcggggcagcaccgacacaccagctccctaccgcctcagccccctacaggctttgggcacccacgagcatgggaggggaagccaaggaggggctgagggcagcttggtgctggcctgcaggtgccccttagttcaagcagcctgggcaccatggacagcagcaggacgcagacgggttcctgggtggcagggggtgggtccccagtgaagccccaccttctggctggagaagatctgaagcctgggggccaggccgccagtcctgtggattggagggggaactcatggtgctttttcctgggcccgcccatggctgtccatggaacaatcagcatgcacttccccaccctgaggcccataaaagccccaggctcagccagagcaggagagacaatgggacaaccagctgcagagagagccttcccactccagcaatgaactacctgcagagaggagaaacacactccaggtcctcctttctgcaaagagctgtggaaatgacaggacaacctgccagcagagaggggccacccaccccagggccttctcctctctgctgagggctgaacactcgtcaggacaccctggttgcaaaaaggagctacccacagtgggtccctgagctgttctactgctcagtaaagctcctcttcatcttgctcaccctccacttgtctgcatgcctcagtcttcctggttgcagggtaagaactcaaggtgccaaatggcaagtctagaagtgctgtaacacaaacagggctgaaacacgccgcttgctctccacattgcaggtgaagagtgggaaagaagagctgaggccctttagggagcccagacctgggggctccccaagccagggctgtgactccctctttgaggccctgcggttcttggagtctctgagcttccaggcactactgcattccccccagggccagccaaagctgcttgtggtgtgcctcctccagctgcagccttgcagagagctgctgcctgtgctggtacctggaaactgctcctgctacttcaggagccggcccacttgactgtgtgcagcggccggactccacactcacttgctcatgcaccttgccactccacgcctggctcaaccttggcagccgtggatccaggccggtagcatgagccaagtacagcctgccaggctgagtgggaggaataagctgaatagactggatcaaaagtcagacaaaggcaccaccaaccacagaggtttctggccagaaaaataacacccaaaagatcccataagaaaggttcttaataacagacatcagtaaaactgcaagaagtgtatccttggatccatgtatcccctgtgcaaaaagatggacaaagaaattgatttggttgcaagggccaactgggagtccatatcactgggaatctcaaactgcaccttaacacaaaacaaaacaaaacaaaaaactccagatgaagaaaactgtctgaaggttgacagcagctacccaagtactttgcaccacactgattaatacttgaagcagcttccactcaagatcatcagagtaagacccaatgaccaaaaccacaaattttcttttctttcttttttcttcttgtttcttgcttctgtctctaacccttatatcgatttggattcctttttgttgatttaaactggctgacagtacactgatacagtttggctgtgtcccacccaaaatttcattttgagttgtaatccccataatccccacacatcaagggagagaccaggtggaggtaactgaatcatggggcagtttccccaatgctgttctcatcatagtgagtgagatgtcatgagatccgatggtttgataagtgtttggtagttcctcctgcattccttctccttcctgccactttgtgaagaaggtgccttgcttcccctttgccttccgccatgactgtaagtttcctgaggcctccccagccatgctgaactgtgagtcaattaaacctctttcctttataagttacccagccttgggcagttctttacagcagtgtgaaaatggactaatacacacaccaacaatgccttattcatgttttttattcttgtccttaatacacgtggtccagagagagcttacgcttaccagggcattttccatctaagagtgtaaagctccagaaatcggaaagaatctggatttttaaatgcatctctgacttctaatgtgtcccttattactggatatcaagcattccacatttctgctcaagatttccaagcttatgatgctaacatgttctgttcaatcatgtggattgaacatatttcatttatacagatcagtatagctatacttatcttaaataatttataatattgctataattatacttatcttaaatattagacccatccaaggcctaaaatcttgtccaaagtttgaactgagaaactgatcaggttttctctaattgtttttgatgtttctacttaaatttttgtaattgtacactaaattctgtgactaacggtaaaattgttttctcaaactttcgcattcatatcatggaaaatttcatcagacccaaatcaaaactggaaactaaaatttggaccaattaccaaattttgtgccaatactacattgaggaaggcaaacatgtttgtgcggttggagaattcatatatattaaacaattaacattcattgtatactgaaagtagaacatacgctttgacagaaagatttcatataaaagctgtactgaatctggtcagtttttaacttgcagaaagacatgcattaataagaacttacatgaatttttaaattccccatttctatcaagcatgttttacacccatcctacgctctcaatggaatgcaaatctacttggaggaattagagatggtgagatccatatctctatgtaaggtatctttccttatcttgcagtatacaaaattcctattgccatggtaatcatttcaaataaaactatatttgcactctaggctaaaaaaaattagcctgaactttcttgataaagtgttactagacaacagaattgcctttgattatacactagcagagcaaggtgatatttgtgtcctgactaatacctcctgttgcagctggatcaatgagagttccttacataaaattcaaggacaagccaacaggttgtccaagtgggataatgcatacagttgaaatctagtctcatggcttgagtttgacaaaaggaggggtactttgtatctattagttatgctgtttctatctctgtttctattcactgctgttgtcaaatgatttgtaaacagcttctgaaatgctgctgcaccatctcaacaaacatcaaatgatcctgaattgaaaggattctaaagtgatctgaaaaaacacaactgaaaaattagcacctttggtagagcgtgatgatggccccaattcttcatccctccagtagcctcagctttttccatgtgccctttctctttgagacacaggaccacaggactacagctgagagtgtaacaagaaaaactctctggtagcacaaccctaatctatgcacaaggtaaaactagagaattttgaatcttgtggttcacttagagtcaccatagcaacaacagaacccaagcccaactcaaatatcacctatattgactcagctccccacactagcagaagaggatgtgctcccatctctatgtaaaacgccgttcattttagcctttactgtgtaacacaacatgttttgctttcaactaaaaattacaagacacacaagaaagcaacaaaaagcaatccccagtcaaagagagcaatcaagagagccagacttagatatcactggatgttggaactgtcagacaggaaatttaagataactattattaatatgtgaaaggcttgtggaaaaattcacaacatacatgagccaatcatgaatttcaactaaaaaataaaaactatgagaaagaatcaaatggaaatgctagaattaaaaaacaaaaaaacaaaaaacaaaccgggcacagtggcccacacctgtaatcccagcacttgaggaggccaaggggggtggatcacttgaggccaggagtttgacaccacctggccaacatggcaaaactctgtctctagtaaaagtgcaaaaattagctgggtgcagcggtgcatgcctgtaatcccagctactcaggatgctgaggcatgagaatcacttgaatctgggaagcggaggttgcagtgagcgagatcacgccaccgcactccagcccgggtgacaaagcaacactccgtttaaaaaaaaaaaaaaaaaaaaacaactatgtaggccacaggcataacacttttaaagagcagaaagaacaaagctcccacctttgaattctatacccagtgaaaatatcttacaaaaataaagaataaagaatttttcatataaacaaaaattgagagaatgcattaccagaaaatctgtgctatcaatataagaaatgttaacggaattttttttttttttgagacagagtctcactctgtcacccaagctggagtgcagtagcacgatttcagctcactgcaacctccacctcgcagctttaagcaattctcatgtgtcagcctcccgagtagctgggactacagacatccatcaccacagccgggtagtttttcgtatttttaatagacacgaagtttcactaggttgcccaagctggtcttgaactcctgagtgcaggcaatctgcctgcctcagcctcccaaagtgctacaattacaggcgtgggccactgtgcctggccagtaaatttttaaagtagaagaattctgatagcagacagaaacttgggccaacacagcaaatggaaagatgctcaacataatttaccattatttgccagggaagtgcaaattaaaaccacagtgagagtccagtacacacgtattaaaatggctaaaaacctgacaccaccaaatgctcgcaaggacgtggtgcaacagactctctcatatcttatcttgcttgaaagaaagcaaaatggtaaagccactctgaaaaacagttcgtttcttctaaagttaagcatgtacttaccctatgaccctctaatctcactgctaggtattacccaagtgaactgaaaactcatcttcacacaaaaacctgtacacaaacgtttaaagcagctttttatgaccacaaaactccataaatagcccaaatttccctcaccttgtgattatgtgtctgcagttgctgccggccagggtgttcgtggtctcgctgccttcaagaacgaagccgggccttcgtggtgagtgttacagctcttttctttttgagaccgagtctcccgctgttcctcacgccagagggcagtggcgcggtcttggctcactgcaagctccgcctcccccgttccggccattctcctgcctcctcctcctgagcagctgggactacacgcgcccaccaccacgccgcgccagctttttttttttctttttgcatttttagtggctacagggtttcaccgtattagccaggatggtcgcaaatctctcgacctcctgatccacctacctcagcctcccaaagcgcccaccagtgttacagctctcaaagacggcagtgttacagttcttacaaatggcacggacccaaaaagtgagcagtagcagctataaagaagcaaaggacaaagcttccaccacacagaagtggacccctgcgagttgccgctgtcggctgggggggcggggggggggggtggccagcttttattcccttattgtccccacccatattctgtttctgtcctatcagagtgcccttttttcaatcctccccacgattggctacttttagaatcctgctgattggtgcattttacagaacgctgattggtgagttttacagagtgctgattggtgcgttttacagagcgccgattggtgcattttacaatcctcttgtgagacagaaaagttcctgattggtgcattttacaatcctcttgtaagacagaaaagttccccaagtctccactagacccaggaagtccaactggcctcacctctcaattagataaccaaattgtgacatatatgtatgaaatactatctatagtgtgtgtatgtatatatacatatatataatgaaatattactcagcagtaaaaaaggaatgaactacagatacacataacagcatcaatgaatctcaaatgtgctattgtgctattaatacgtgaaagaagtcagattctaaaggccatatgatatggtagaatgggaaaaacgttaaaacaaatcaggagttgccaatgctgatgatatggtttggctgtgttctcacccaaatcttatcttgaattataatttccataatccccacatgtcttgggggggaccaggtggagataattgaatcatggagcagtttcccccatcctgttcttgtgatagtgagtgagttctcatgagatctgatggttttataaggggtttcccccttcactgggcactcatttttttctctcctgccaccttgtgaagaaagacatgtttacttttccttccaccatgattgtaaatttcctgaggccttagcctccctagccttgcagaactgtgagtcaattaaacctctttcctttataaattacccagtctcgagtatgtccttatagcagagggataattgacgaatacaactgggaatttaggaggaggtggttatcaaaaagcggaatgggggaaggtagaatttttaggggtgatagaatcatcgtgtatcttgattgtgtgggtggtgggtgtagtggttacacaactgtataagattcaaatctcatagaattctatactaacaagaattttactgtatataaatcacacttcattaaatataaaacaaatcaataaaaaaaaacaatctactcaatacaacacccaagactgatctgaatgtgatctgaatctgaaagcctgataattctctcatcctttcaggtcaacctttcatctctgaatgaggtaaggacattataaaggactataaaaaaaactttataattatagcaatacttgcctggggtttgatcaaacatgaatattattttgaccagccaaagctgttaaatgactataaactttgagcaatacactagcaaaggtgataaacaaccaagaggtgatcctcacccaacctaacgaaaattctttcccaactaaagagcaatgagactcacttcacacaacatacagatggatgcattctgcccagtccaggctgtgcgctgcaattgttaactggcaaaatcacaatgaacctgtcctttctagcacataaaattcctgatttttttttccctgtggggatccactcaattgaaataaatatagtgcttacattttcagtcagtaggtggtccttatcattcctttaataatacacccagaggctgggcacagtggctcatgcctgtaatcccagcactttggaaggctgaggctggcagatcacgaggtcaggagatcgaggccatcctggctaacacggtgaaaccccgtctctactgaaaatacaaaaaaattagccaggtgtggtggcatgcacctgtaatcccagctactcaggaggctgaggcggaagagttgcttgaatccgggaagcggaggttgcagtgagccgagatcacgccattgccctccagcctaggagacagtgcgagactccatctcaaaaaaataaaaaataataataataataatacacccagaaaaccactatcaccactgtctaggtcatgaaacagaacagactggaaccacagtaataatgcattttcccaaaatattacattcctgcctccctaaaggtaactactatcatacttttaacaccatagactagttttgcctattttgtagcattgtgtaaattgaaccatatagtataaataattttatgcctcaaccttatgcttatgggagttgtccatattacagcatgtgtaagtagctgttcatttttattaccgtatgatattccattgcacgaatatgccactatattttttttttttgagacagagtcttgctctttcacccaggctggagtgcagtggtgctatatgtcagctcactgcaacctccgcctcccaggttcaagcaattcttgtgcctcggcctcccgagtagctgggattacaggtgtgcaccaccacacctggctaattttttttgtatttttagtagagacaaggtttcaccatgttgcccaggctggtctcgaactactgagctcaagcaatccgcctgccttggcttcccaaagtgctaggatttcaggcgtgagccaccacacccagccaccactatgtttatgtacctgctatcagtgaacatttaaattgtttttggcttgagctattataaataatatgcaaggataaataaatgcaaggatctttccattacactatggttcaaatgtgccccctccaaaattcaagtattgccaatgtgatagtattaagagatgggacttttaaaatgtgattcaaccatgagggctcctttttctaactgaaattaggtgcccttctagagggacttgatggagggctttgctctctcttgcccttctgctgtccatcctgtgaggacacacacacaaatgccctcagcagatgccagtgacttgatctttgacttcgcagcctccagaactgagagaataatttttttttctttataaattactgagtctcaggtattctctcacagcagcacaaaattgactaagacatgtacctttcagatgtgtatcttttgggtttcgaaccatgtgactatattacctcttcaaaattgaatcaaattaaaattgtaaagtaatgaacaaatccagtgagcatttctttggatttctttctgacaagtagtagtgcaaatacactctgtgtgaaaagtagttttaaagtagcactttattgttatcattggcaattagaatccaataattacagttgacccttgaacaacacaggtttgaactgcgtgggtccacttctatgaggacttttttcaacccaacgaggattgaaaatacagtattcatgggatgtgaaacctgcatacacaaagggccaacttttcttataggtgggttccagaaggccaactgcaagatttaaagatgcacagatttgggtatcctctggcagtcctggaaccaatccccctcagataccaagggacaactctataattattgtaaagcattaatgatatttacatgaattaagagtgtggttgtaattacagcatttttttgctgatttgtaaagaattctccatttaatgaaaattagtaaacaaggccaaagatgttttaactgaaaaaggaaattaaaggttcatttgaaagaatcagacaattgcatcctctgagaagatttttttgtttgtttgttttgttttcttttgagacggactctcactctgttgcccaggttggagtgcaatggcgagatctctgctcactgcaacctctgcctcctgggttcaagtgattgtcctgcctcagcctcccaagtagctgggattacaggtgcacaccaccatgcctggctaatttttgtatttttagtagagatggggtttcagcatgttggccaggctggtcacgaactcctgacctcgtgatctgcccgcctcggcctcccaaagtgctggcattacaggtgtgagccaccacacccggccgagaagatgtaattttatcacataaaattcagataccctcactgtgttttaattcagctggctaatttatctgagattatactttaaaacctgagtataaacaaaaaagaggtatgtaacattaggttgactgttacaattcagtagaatatttaatgagctacacacatacacacacatttacaagcatccaaggctataatacacagaaatcataaaaccaatggctgacagtctccacttcattattactgtttactgtaaggtcattattaaagtagtgtgaaaactgttgcccaatggaataactgttgttttccatttcaatacaaacgtagtcagtgacacacacattaacctttaaaacacccatgttttccatgtccatgtctacctaagacatcagaaaactatttacttaaagaaaatgcgccaggcatggtgtattacgcctgtaatcccaacactttgggaggccgaggcaggcagatcacttgaggccaggagttcgagactagcctgggcaacatggggaaaccccatctctactaaaaatacaaaaattaactgggagtggtggtgggtgcctaaaatccctgctactggggaggctgaagccagaggattgcttgagcccaggaggtggaggttgtggtgagccaatatcgtgcaaccgcattccagcctgggtgatgggagtgaaaccctgtcgcaaaaaaaaaaaaaaaaaaaaaagaaagaaaaaagaaaatgaaataaaatacagctgcataactgaggctcacaaagctactctgccatgggttactacaggaaaatggagattctgggagaagaaatagtatatacatccaaaagttttggttttgctgcagtcttattgtgcctgcttttaaaaaatccgatgtgaagattttccccaaataaaaatattttttataataggataaagttatatcccagcatagtgatattcatgaccatcctcgcccctcctttgtatggtctttgtgtcattcttgacaggtccaccattttagtgcattacaccctgcaacctggctccagacagaagactccctcttcttctcagaagcctgcctgggctgcacagggccacctcgcccagcagtgttcacaactctgtctgctggctctctgctgcccctctccatccatgccacgcacacgagcccataaggactgcctcccgattctttttcttttttttctttttttgagatggagtttctctcgtgttgcccaggctggagtgcaatggcgcaatctctgctcactgcaacctctgcctcctggattcaagcaattctcctgcctccgcctcctgagtagctgggattacaggcatgcaccaccacgcctggctaatttttgtatttttcttagtagagacatgttggtcaggctggtctcaaactcccaacctcaggtgatccgcccgcctcggcctcccaaagtgctgggattgcaggtgtgagccaccgcgcctggccaggactggctcctgattctaacggttgcccggaatcccgtgcccagcccagctgagctctgtacccactagggtacttgatctgctgtaattgctctgggcctcagcctctccatgcagcacacacacacatgcttggtgtgcttcacaaggatatagggagagctttaggagaggcagacttgtcttctaagaatcatttttagtaataaatagcatggtggggtggcgggtgcagtggctcatgcctgtaatcccagcactttgggaggccaaggcgggcggatcacctgaggtcaggagttcgagaccagcctgaccaacatggagaaaccccatctctactaaaaatacaaaactagctggattataaatcatgctgttataaagacacatgcacatgtatgtttattgcagcactattcacaatagcaaagacttggaaccaaccaaaatgcccatcaatgatagactggattaagaaaatgtggcacatatacaccatgaaatactgtgcagccataaaaaagaatgatttcatgtcctttgtagggacatggatgaagctggaaaccatcattctcagcaaaccatcgcaaggacaaaaaaccaaacaccgcatgttctcactcataggtgggaattgaacaatgagaacacttggacacaggaaggggaacatcacaccccgcggcctgttgtgggggagggggaggggggagagatagcattaggagatatacccaatgtaaatgccaagttaatgggtgcagcacaccaacatggcacatgtatacatatgtaacaaacctgcacgttgtgcacatgtaccctaaaacttaaagtataattaaaaaaaatacaaaattagctgcgcatgatggtgtgcgactgtaatcccagctacctgagaggctgaggcaggagaatcacttgaacccaggaggcagaggttgcagtgagccgagatcgcgccattgcactccagcctgggcaacaagagtgaaactccatctcaaaaaaaaaaaaaaaatagcatgggggtatgaagcctcatattttgataataaattgctcccagcatatattacaatctgatgcattcttaaatgtgaattcctttgtgctataaacgttaagtgcctcattttctcaatgctgtgagcttttaattctgcagcatggctctgtgactgtgattgtgagtagggacggctgtgttgatgtgcatgtggtcattccacaccttaaacgtgagaggtgcactctggtctgtggtcaacagctaaattcctctatctctttaaacttcactgcaccaaactggagaacccacagctgctgtttcccaatgggtctgggcagtatttgaggctggtttgcaagccaactataattttctgtagtggaaagagactctttatttttctctctctctttttttttttttttagcgctcctgcgcactgcctgatgttccctccctgggctggatgccgacgctgggagactcggaagccgcgtgtggaagatggcagtgtgggtatggcctgggtgcttgcgtgatggggtggagggagtcattatccccaacacaaacgcgcccactgactcggacccgcattggactgtgggacctgggcagactccctaaaatgtgggttttgtgatagttataacagcctgcattgactggtcctcggccagtctcagggtctttggcaatatttggaactctcttggccctttgtcttttgatacttatctggccaaatttggcctgaatggaccaaacttctgccttttctgtttctgggcaggcactgttgggcactgccagagagaaatctcaaagtcagatgttacactgtctgggatgcagctgcgcccagcaatcctggtgtgtccccaatccaactttctctgccaccttctggagtggctatttcaagtctccggttttctgaagtccttaagtctctctttccacttcaaagagaacattgcagtcatcggttgggaacttgctccaagtgaggagcaactgtgcccaccctcccatcctctcccacacctggggagttcatggctagccctgccctttgggcactggctcccagccagagacctctgcaggggcagtgccccatctcatgccctctctttcctgcaccttcctctctgctagtgcccttcttctgcgtatctggctgtgtaggagaagttctctatcagcagagcctagttcaacagttaaaaaaaaaattcaccataggtttcatgccctgaataccacttacagagcagctgctgggtacttgcaatataggcaaaatgcagatcttgctcaactcttctggtgtctgttaactagccattgcgctcccctagataaaatggctctctctagaggggtgacacagatcattcatggtgggtagcagacatcaatcgctaccacttgttttcttgctggtggtaatggagaccctccagggaacccttacacccctctgaatctcctcgtgggaggaaaactgggttgtgctctgaaatgtcgttaaagtcatatttggagagctgcgctgactctgaggagctggctgagatctctttcttcctgaacagcatgccagctgccatgcaaccattcctcacgcaggcagcacaggggaaagcagggaggccacatcttggactctaacgtaatgattttttttcctgcttctgtggttaaacacatttagaggacctgttttgaaggttcctatgttcctgtctgcgttatgcaaattataggcacgtgtatgttaggaatgcaaggaacttgtttacatcatctttttttttttttttttttgagccagagtctcgctctgtctcccaggccggagtgcagtggtgcgatcttggctcactacaaccttcgcctcccgggttcaaacaattcttgtgcctcagcctcctgagtagctgggattgcaggcacacaccaccacacccagctaattttttgtgtatttttagtagagatggggtttcaccatgttggccaggctggtctcgaactcctgacttcaggtgatcctccagcctctgaacccaaagtgctgggattacaggtgtgagtcaccgcacctggcctacatcgtcttttgtgaaaaaaaaaattatttatacacttgaatgtctaatcagcgtttcaaaggtaacatgcccaaaactaaattctcagtatccctcctccccagccaccttcatcccagcaggggtgtcaccagcagctcaggccaatgatccagcagtcagacttgactccgctcatgctctctcacccatctaacccatcagcaatattactgggtctgctttccaaatccaccctcattacacctccccccactcacccccaccctcgcccagactgccaccatggacagttacagtggccttctaaaggtcatgtctcccccattgtcttctctcccaaattctattttccatagacaagctagactattttgatcatgaaaatctcactgtgctgctccctgcttacaataacctcctctcccttatggaatcaaatctgaagtcctcaccgtgcctgcaccagccctccagcatccctgtttcttgggcctgccaggccagtccccacctcaggacttttgcacttgttatgtcctctgccaagaaagctcttccctgagttatcagttcctggagtggccttccttgacactgtagtttcccagggctgctgtaaccatagactggagggcataaacaatagaaatgtagtctctcacagttccagagccagaaatccaaaatcaaggtgtctgcagggccacgctctctcgctctgaaagctctgagaaagaatctatcttacttatctttctcagcttctggtggttcccataaacctgtgatgctccttagtttatagacgcgtcattccaatctctgcctccattgtcacctagcactcccactatgcctgtgaaccttcccttcttataaagacaccagtcacactggattagggcccactctaattcaccatgacctcatgttaacttgattacttctgtgaagaccctatttccaaataaagtcacattcacaggtgccaggttagggcttcaacatatattttcttttcttttctttcctttttttttttttgaggcagagtctcactccgtctcccaggctggagtgcagtggcgggatcttggctcactgcaagctctgcctcccgggttcatgccattctcctgcctcagcctcccgagtagctgggactacaggcgcccaccaccatgcccggctaatttttttgtatttttaatagagacggggtttcaccatgttagccaggatggtctcaatctcctgacctcatgatctgcccatcttggcctcccaaagttctgggattacaggcgtgagccactgcgcctggcctttttttttttttttttttttgagatagagtttcgttcttgtcacctaggctagagtgcaatggcgtgtggtctcagctcactgcaacctctgcctccaaggttcaagcgattctcctgcctcagcctcccaagtagctgggattacaggcgcctgccaccacgcccagctaatttttgtattttttaagtagagacaaggtttcaccatgttggccaggctggtctcgaactcctgacctcaggtgatccacccacctcggcctcccaaagtgctgggattataggcgggatccactatgcccggctgtcttcaacatatgtttttgggagacacacttcaatgcatgaaaacatcctatatcctatagatgtagagtcgctatttgctctacatcttggcctgttttcttcaccccatgtcattttccactatctgaaactatgccccagaggatagtggcagctgtctaaattagaatctccctacccattctccttaaaactgtacaggtgagcaaggagagaagacacccattgctcctgtctacaccacatctagaaggcagagaaaggaaaaagtgtcttaaaaaagtaataataaggacccagcaagagagcaccctagccaatcaatcgtggaagaaaagggtgtcgttgattaaagaaactgcccttcactctagcaacagaagagggagcagttgatctgcacaaccaacaggccgctcgggcctctaggcctccactgcattgtctgctattgccagtccggggaaacgcaacagaaataaccaccaccaatcacaaagcagaaaaggagaaccatactttccagcagatggcgccacttcggaaaacagtttggtgcgtcctcaaaaaattaaacatataattaccgtgacccggcaattccactcctaggtatacccaaggcaaatgaaaacatgtccacatagacacttgtacatcaatgttcctagcaatattactccttaagagccaaaagatggaaaccactcaaacgcccgtcaactgatgaattggtgaacatgttgtggtatatatcgatacaagagactatttgcggtaaatagggatgcaatactgattgatactacaacatggattaactttgaaaacattgctggggctcggaagctgatgccccgaatttgatgctttgtacatgctgaactgaaaaaggagcttcaaggtctctctcctccctcctgccccaaagcataggcttctctgacattcccttatctgtctaaagtctgggtctatgaaagaaaaacaatcacctccagtcacttccctgagttttcattaactgcacccatatctcagaaaggaaaactaaagtcggtcaacacacctggacagacttttgtcacaaaccattgtctgctctgcaggcccagcagactttaccgcagaccgtggtgtgttcttcaagccctttgaatcttccctagtcatcatttattgcccctccccagaattcctcttctcccgctcccataactacgaccagggaagattcaaagggctaaaaatacaaaaattagctgagcgtggtggcacatgcctgtaatctcagctacttgggaggctgaggcatgagatttgattgaacccgtgagatggagaggttgcagtaagccaagattgcgccgctgaactccagcctgggcaacagagcgagactccatctcaaaaaacaaatcaaaacaaaaacaaaaaacaggtgattgtgtcatgggggctctgcctttgtgaatagattaacccattcatgaactgatggactggtgggttaatggattaatgtgttatcacagagtggaattggtggctttataagaagagaaagagacatgggccagcatgttcagccccctcgccatgtgatgcccggcaccaccttgggactctacagagtccccaccagcaagaagccctcaccagatgcagccattcaaccttggacttcccagcctccagaagtgtaagaaataaatttcatttcttagcaattactcagtttcaaatattctattatatgcaacagaaaatggacagagagagttcttaaggaattccccatcacatccgaggcttatccagaggtgatccttgtctggttccccaggaggctcctggaggaaaggaatggacactgtccaccaccccattcattggatgcagggcccgaagggaggacctgtggagggttttccagcggctcccttaaaaggaacctggagagaggtgattgaattacttcctcagtgcatcttatttgttaatgacatgctcatttcaatgatccatgtcatcccggtccctattaccataaataacgaagcattagctgtacgtggcagtggctgtctggagcagcaaagagccgatcccacggtgtgtctgccctgtcaaaatcatgttggctgtgcttaaaaatgacactccagcctgtccctgcaatccccatgcgttttcatcatgagtcagaacttcaagatgctattcattccgaagccatgtcagctcagctgtcaagcaagtttatcgcatcttgtatttatgataaacttgagtgacatgcagattttgaatatcatattctaaagccattttaatctaggctaaatgcagcctgtcaaattcccctgtaaggcaggatccatggtgggggctggggactgaagggaggtgacagcagtgcggttggcagacaggggagagggaaggtaagcaacagagaaaggtgcctgggttcccaaacagggttccagaggcaagtccactctgcctagaagtaagatggctctggggcaggacgcatgaagggtctcgcccagaacagtggttccagcggtgattcccagggacctatagaaaccctgaagggtggggaagcttgagtcacaagatgtttcaggcctttcgaggactaggtatttgtgaacacaggccagccttggaaattgaatatgctctcgacttacaatgccaccacttaagaggttgttgggctgggggttactcattcagggcactgttgtcccttctgggatgagaaaagccaaattattacacgctgaagcagatgtgtggggcccgaggtttatgccacccgggaactctctttaaagaaaatgaaaacaaaaattgtggtagagaattgctcgggtccctccaaggagcctacacaaagggcctgcagtgaggggtcccagtaccctaggcacagaggaccatgagctgcccagggcctcatgcctggggaaggctaagatgtgaagcatggtgatacaataagaaacatagatttggtccttgtctctgttcctggcacagagggcctaagacctttggaatctctgcagtgagaataatgaatgttttttgtgtactaatgagatgactggtggctgggagcccctgaacagcttcaggatgagggctggtcccagaaagaccaaggcaggattaggaggttggaactttcagccccactccccgcaaacctcctctggggagaggagacaggctggagattgggttaatcaccagtggtcaatgattaatgaatcatacccatgtcatgaaaactccctaaacattcctgaacaacgaagtctggagaacttccaggttggcaaacacagccatgtgctgacagggtggcacaccccgactccatgcggacagaacctcctgggctccggacccttccagacctagccctggctgttcgtctgtgtccatggtaataaactggtaatagtaaataagtgttttcttggtttctatgagctgttctagccaattattgacctgagggaggtggggattgtaagaacctcctgactttgtagccaagtcggacagaagtgtaggttctctgagtacctaagacttgggactggcgtctgcggtgtaggtgatcttgtgggactgagcccttgaacctgttcaatctgacattagttagtgtcagaattgaattgaatcataggacactcagttggtactgagaactggctggtgcgggaaaaaatcccacatttggtgtgagaagtgtttgagtaaaaacagctcaagcccattcttcatttctcagcagggtggcttttgtttgctttgctgttccaacatttcattactcatctgggtcccaatgggcctttattaagaaaagaaaccttttaacataaaaattggctccagatctgagccactcatttcccctgaacctctctggggtccttgtgggctttctgtttggacaggtgatcccagcgattctcccagcttcagaggctgagaggctgtgatccccatcaaaggcagcacatgccacagtgtcccccaaggagcccccgtctgccttgaattccacctacagtggcacagaattggcagtgggcacagctggctgccatggcttccaggggctggaaggagacggtttactgcagggattctttttttgtttgtttgtttgaaacagcatctcactctgtcgcccaggctggagtgcagtggcgccatcttggctcactgcaacctctgcctcctgggttcaaatgattttcatgcctcagcctcccgagtagctgggattacaggcacacaccaccatacccggctaattttttttatttttagtagagaggaggttttgccatgttggccaggctgatctcaaactactggcctcaagtgattcacccgccttggcctcccaaagtgctaggattacaggcatgagccaccgcgcccggtttactacagggattcttatccaagggcctatggatcccacaatggcatgtacaatttttatttttaaggtcttcttttctgaggaaatcagttgtccaattttcaaatgggtccttgactaccctcaaaggttaaaaatgatttccaggtgaaaaataaagaaaaacactgttgcattctctattttttttttctaaaagtcaaatcaagtatgggaaattccagttatccagggtgcctcaaccagggagcttctggctgcttgaacatggagtcaccacacacggtccatgtgtaattgcccaatgggctctccatacccactgcctagacagagccgatttatcaagacaggggaattgcagtcgagagtttaattcacgcagagccggctgcacaggagactggagttttattactactcaaaccagtctccctgaaaacttggggatctgggtttttaaggataatttggtgggttgggggggttggaaaatggggaatgctgattggttgggtagaagataaaattgttgctggaaaggggtcccaatccagacaccaggaaagggttcttggatctcacgcaagaaagaattcagggcaagtccatcaagttggtgactccataggcagggcagtggcatgagctgctcgagggagtatacttagttacttcttgattatatgctaaacaagcggtggattatacacgagttttccaggaaaggggaaggcaattccaggaactgaaggttactccctcttttagaccatagggggtaacttctggacgttgccatggcatttgtgaaccgtaatggtgctggtaggagtgtcttttagcatgctaaacattataattagagtataataagcagtgaggatgaccacagctcattatactctaattattaaaagacgtcgccatcttggttttggtgggttttggccagcttctttaccacatcctgttttatcagcaaggtctttatgacctgtatcttgtactgacctcttacctcatcctgtgactaagaatgcctaacctcctggggatgcagcccagcaggtctcagccttatttcacccagcccctactcaagatggagtcgctgtggttcaaacacctctgacaaaatcacggaaagtcgaagctgtcctcttttgctgaatcagttcctgggtagaggccacaggatcccatgtggtgccagctgatcatcgatcatcatgtgcagggtctacaaatcatctcaagcactgatcttaggccttaccatagtgagtttattctcaggagcaatttgggatggctcagaatcttggagtctccagatgcatgactcctaaaccctaatttctaaccttacagctaatttgttagtcctgcaaaggcagtgtagtccccaggcaagaagggagtttgttttgggaaagggctgttattgtttttgtttcaaagcaaaacaataaaccaagttcctcccaaagttagttcatgcccaggaatgacaaggacagcttgggggttggaagcaagatggagtcagttaggtgagatctctttcactgtcatagttgtctgttataattttgcaaaggcagatctaccatttctctgaaggttgagtttgggatgtggtagcctttgagtacccgtcctgttgctgtgtgtgtgttcagggcaatccaggaaatctggagaaaccagagtgtgtggtcccccttccccatttctctagtggatcaggtaggagggtgactgaggaaatgtgtcctgggatacttcctgcctcccagggtgtgtgggactcagcccttccccagcctgcagaggatgggggggggggggggctttgccagcagtcaagtcctgtgccccaggggaccaggaagcctgtatcaactcctcgctaccccagccagaagcagcaaacgctccaccctgtcctgctgcctgatgggcagagttgttttttttgtttttgtttttgttttcagacacagtctcattctgtcgcccaggctggagtgcagtggcgcaatctcagctcactgcaacatctgccttccaggctcaagcgattctcctgcctcagcctcccgagtagctgggactacaggtgcccgccaccatgcccagctaatttttgtatttttagttgagacggggtttcaccatgttggccaggatgttctcgaacccctgacctcgtgatccgcccgcctcggcctcccaaagtgccgggattacaggcgtgagccaccgcgcccggcttgagcacagacttttaatcagattttttctttctttaaattcctgtgagaccagccgcctgagggattaagaatatcgagggatggaagggagagtaaaagaacgggcacttttccctagggaaaaggaggcatgccgggggggcggagggaaggagggggtgtggaggagggaaggagggaaaagggggagggaggagagggaggagggggcgcggaggaaggggcgggcttccccctgccggcctcccttccttccccgctgcctccgcctctcgcactagcgccccgcacctgtggcgcccctgctccgcccagtcccgcggcctcctcgcccctagtccccggcgctccccgccccttcccgtgggatccgcccctccgccagccccgctggcttcccctctccgccaccccggactcagaacctcccctcccccgccggggcctgggcgcgcctgcccttcgctccccgacctcctgctgcagctctgggcccctcggccgctccctcccctcctcccttgctcaccccacggttggccgcggatctccagcacgccgccccagtcctcggcgtcccgcagcgcctgccagggtcgccgagcctcccctgcctcctggccgcctctgcagtgccgtcctcccggggctggctctctccccaggcccccgctttggccacccaggcactttccgccctgagcgtggcagctgctgccgggggtcctgggaccgcgggatgggaactcccacgcagcgtcccacaggctcctggccgccgcgagcccgcgcgactcgcacgagcatgtccacccgcagcgaggggccggtcactgctacggagcccgccagaaggcaaagccccagacagcaaatagggaggcggctggcacccagggaggccgaggcgggaggatcgctggagcccaggagttcgagacctgccttggcaacatagtaagacgcccccccaccccccgcccaccatctctacaataaatttaagaattagcctggcatagtggcgcgcgcctgtggtcccagcacttcggggaggctgaggtgggaagatcacctgcgcccaggacggtcgaggctgcagtaagccgagatcgcgccactgcactccagcctgggcgacagagcccagaccccgtaacaaagcaaaaatgaaggaggcggcggtttacttctggaataactgcagaagatcatcaagtgcagggagctgtggaactcccgggcgcccagccctcggcgcccctgcaccctcagccgtagagctggggtgttccggcccggagggataggggtttgcagggtgcgtgagcgccgaggctgcccgcgaggcgagagaattgcggggggaggcagggaggccgacggggagggcctgggaggctgcacgcgcagcggggacccggctttgtcccgagcagtttccaggtaagagctgagaggaggggagggagggagaggaggagaaccaggcccggattttcccgcctggggtcaaaccaaagcaaacaaaccaaagtggtgtgtccaaagtgatgcgcctcacaggtgccttgcttctgcccctgccggagttgaggtttggaggaagggcactgtgctgagtcccagcgggggttttgtaaatgctgcggtattggtctctcacggttcacggagcaatcaccacacttgcttgacctcctggaaagccttactctctttttataattaaaaacaattttttttggccgggtgcggtggctcatgcctgtaatcccagcactttgggaggcccaggccggcggatcacctgaggtcgggagtcggagaccagcctgaccgacgtggagaaaccccatctctactaaaaatacaaaattagccgggcgtggtggtgcatgcctgtaatcctagctactcaggaggctgaggcagaagaattgcttgaacccaggaggcggaggttgcaagtgagccaagattgcgccattgcactccagcctgggcaacaagagcgaaactcttgtctcaaaaaaaaaaaagaaaaaatttttttttagcgacaggggtctcactatgtaggccaggctagtctcaaactcctgggctcaagtgttcctccagccttggcctcccaaaatgttgggattacagacatgagtcaccgagcccagccagccttactgttcagaatgatgtcacatctttgtggactgttgaaaataaggttgtcttcctcagtctcctagaagccccaaaatagccatgcagatgtccaagcagttctggtttgattatcaaggagcatgtgtaaaatagctacgtgtgaatggggtctctgcaaatggaaactggcgggggaggctcaggactcttaagaggtctgcaggagaaagtgcataatgaacacacacccatggcctctccccatgtgccagggcatcctcccacacaggccgaaagtgctctgcagaacaaagtgcttttggtccacaaaacgcctcccagctcttgcctgcaaagggaagaaaggatagctgagaatcatgaagcagaatgccgggagatttatggaaaccccctctgatagctcaatctaattgcagctccctccagcgtgccaaatgctgctaatggacagccgctcctgccgctctgatgttgctagacctcctcagcactcagcccaaggcagccaggaagaatgaacgaatggtgattcagagggaaaggaggaagctgcgtggcatttcagagatacttattttaaaactgctggtggccatgtcttcttttcatatcagagctaatgagttttgatatgtgaacatttcttctccttcataggtaatgtgttgatttggcactttaatcttagaataatcatttctaaaaccaacccaactgcttttctttacaattttggccttagcaaacagatgagtccgttgacttgagcattgcttgggcactgtctgtgtgcaggtcaggcaggggatgctggtggctgggaaacatagaggatggaggtgtcttgggtgtacatgaaggggtggggtcaagtccacagggggtcggcccctggcagcagtcctggagggcttcgtggaggaagggagaattgagtgagaaagtggtccccaggtaagagggaagagcatccagggagaggagactgcttctgggaagaccagaggcatcacctcgcaggggctggtatggtggtggctcaggtgggaggaagagagacctcagggaaaataacaggttccattgacaggaggcctgctctggtggggaggcaggctggtggtggagtcatggctgcaggccagggagatgcctgaccaacaggtgtgttggccagggtccctgtagcaaaaacacggagctgaggacctcatggcagggaccccatgcagagggagccgcgggtggcatggggatagtcacctggctctcctgctctcggcctcctgcagctcccctcactccctgccctgccacacaaggtcaaacccaccaggaggcagaaggcgaagggcgaggtcccagggtgaggagcagggaggagatggtggcagcagggaaggtgatgcctgctgcagagtgagacctgggactgccaaacacacagtgacgggagctgaggaggcctgccgggggaggaagacagtggctggcagtgacaggaagggagggtcagcatggggcggcagtcccagagctcagggctccctgccaggccagcctttgtggcctgtggggtggaggtggcaattgctgtcatgtcataaacacgtcaagcttacaatgaaatctccagtgtggcttgggagcaaatacatgtgcaggtgtttgagtatctgtgctcttacctaacctcagggagcaggaaaacgaaagcttatcatgtaaacacatcagcagcagggcttatgtgtgtctccacactggaacccccaagacaagagactggaggcagagttgatttccaagcccagagtgctgggcagcctttgggttttatgtctgcttgcttggagctcagtgatagaaatctaggccccagaagaggaaaggactgtcctgcataaccagcacacccggggaatgcttcaggtgcagctggatccaggcatcctcaaatagtgtgattaggactccactttcctttgtcaccttggcttggctcttccctgctctgtgttgttttcagacgaggtggggccccagcagctctggtcctcctgacatcctagagaagagccagcccttccctcctggggtctacaccgtcccctaagggacctcagactgggctgatggaaggtctcaagcaggccatgtgaagggcactgcacaggaaacacagaaacgggaatcctataaggtcagcagagctctgagccctttgttcttgggcctgtttttatgatcctccctctacatgtagctcacacttccctgcttctgtgcaggcaccaggtgagggggttgtcatggcctcctgccactcttgaggctgtcagatattacctgtgctgtccctgcattctcaagctccaaattgtcaactaagaaatggtcacttaaaaagagaaaagtgaggccgggcacgctggctcatgcctgtaatcccagcactttgggaggccaaggcaggcggatcacctgaggtcaggagttggagaccagcctggccaacatggtgaaaccgtgtctccactaaaaatacaaaaatcatccaggagtggtggcgggcacgtgtaatcccaacttacttgggaggctgaggcaggagaattgcttgaacctaggaggcagaggttgcagtgagtcaagatcataccactgtactccagccatggcgacagagcaagactccgtctcaaaaaaaaaaaaggatttctgaaatggacgaagtttttttccactggcggtgccatcagtgatcgtgtctgttccactgtgaagtcggtcgtgagctctgtgacgtttccctctcaactcaaggcttttttcttccgcttatgggtgtagtccaaatggttgggatgaaaatcgtttcacagataaagaaatctacaagcccaatcgtggtgtaagaaaaaaactttaaaactctgtcgttcagaaggaaatcaggaataagaatttctcctttgagactaaaagaaagtcagctttagccagtgcattggggtgctggctcgatgtggtaaacaaagcaaaacattgtttttaaatatccaaaacattatttttaaatataaagaaatacatttttctcctctcaacaatgaagtcatagtttttttggggggcggggggtgggtgggtgggtgcacaggatttactgttttgtttgtttttttaacccaaagagaaggaaaatactttccttactcctgaaaatggtgagtttgtacattgtccttttatatggatcaatgtcatttaagcaactacagacagataagtgaagatgaatctcatccatcagaggctgggctatcaggcaccaggaccaggggcttttcttttaataagggaaacctctgctatctttggattcctcaaagcctggaatctagagctggatgacaggcttgctttggagagaatttcttgagacaacttcaaagtggcaggttttgttgaagaaaaagctcttcatggggtagttgggaacatggttagtccctctgtggggaccaggaggagcggagaggggaaagggagggagagggagagaacaaactctctgctgtcactctaagagcgccaatcccatcatgggccagaccctcatcgccttatgaagcctgatcacttcccaaaggccccgcctcctggtactatcactcagcagtccccaaccttttttggcaccaggaactggttttgtggaagacaatttttccatggactgggttgcagggatggtttcgggatgattcaagcgcattacatttattgtgcactttattattattacactctaacgtataatgaaataattatacagctcaccataatgtagaatcagtgggagccctgaacttgttttcctgcaactagacggtcccatctggtggtgatggaagacgatgacacccgaagtgtgttgctaatgtccagtctgctctgtaatctcgttttggtcgatgatattgcagaaaactctgcttcacaaacacaggatattggaaatggaagtgggcttttcagtgctttgggaacaatcacaggagattctgccttggctgtaatccagaacgtatggagatttgaagttgtcgcaaacatactttgaaggccaccagatgcagctgtacaattgaagtccatcagctcacttgcctcaataaagcctgccactgcatgcagcttgtcacttgccactcacagatagggttttgatatgactctgcaagcaattgatttatgatggtctctgtgctgtcaaacctctctgctaatgttcatctgtatttgcagccactcccaagtgctagcatcgccgcctcagctccacttcaggtcatcaggcattagttagattctcataaggagtgtgcaacccagattcctcacatgcgcagttcacaatagagtgcgctgctatgagaactaatgccactgctgatctgacaggaggcagagctcaggcggtcatgctcacccacccacctgctgctcccctcctgctgtgcggcccagttactaacagtccatggacaggtactggtccgtggcccagggactgggggccccttctgtcacccaaccaaactgggtccacttgccctcaaggaacggaagccaaacaccgaagcaccaagtttttgcaataggaaggctttattgccagttgagtgacatggagaccggaggaaatgttcctatctgtcttcccactggccttgccaccatagatgtaagagacagattttgagggtggggtttcggggcgggacgaagattggctggaaggaaggggctttgttgagtccctcggtcactcactgtcgccctacctgctgcttcatgggttgcatgtttaaaaacaatgttggcattagcatgacctggaagtggggttttgggccctctgacatcaaaaggtggctcgtgggtgagtcagtgcactctgcagactctagtcagccatgttggctccaactggtccctcctggcagcccacttagttgcaaatagaggggattgtagcaaattgtcgtcttctccactgtcctgcaaaatgagctcaagaaattttgctggttaacaaatcctgtctaatcctagggcaggtttcagtaccatcctgttagggattggggcttcaacatatgaatttggggggtacacttcagcccatggcaagctggatacttgtgctcccttcatcaagatgagaatgtgaacacacagaggcaaagcggcccatacgaggtcacagtgagagagggtgccgtggagtcagaacgcacagcagggacccagcccctaggttccgtctctgagccccaggtcccatgctgagctgcaggagtcactgtgtgcctctgctttgtgctttgtgaccacacgtcatggccaggctggggttttccaccctttgtgcgttattcccatcttagtttgaggtcagaggcctgcaggacttatttcctggtccccacgggatgaaggaggaaacccgtgggaactagcacatggccctaaaagcaacctctccttgccctcattgtccattagcacaagacactcccatcagcaccatgacagtttacaaatgctgtggaagttgctgccttttccttagagatttccaaataacctgcccctaatgtgcatgtcattagaagtcagtataagtggctgtgagtgcagctgcctcagcccatatgctgctgactccgggtgcactgctgaggagtcagccctggcccagttcaggaaaagtggctgcataatgccaccagctggcccttgcattctttcctgggtgaagccaagaaccctcaggggctaagccccactgtgagagctcacctgccacctgcatccagtgaatagggcgccatttccaggtttccccccagtgctgcagcaaacatccctgtaggccgcaactcacacgcttgcttgcatttttttttttttctgtgagataaatcttcagcagcaggattgctgagctgggtctaaaggctttcaaagttttattttcaattttttttttctcaattgtctgtaagagggcagaaccactttactctcttccagtggcagatgagaatgtgcttcttaacacctgcccagccccagggattatccctcattttagtcttggccaatctgagacaatccatgaagggaactgatgactcgctgtcttccagacatttcttcggtggtggtgaagttgagtatgtctttatgcttattggccattgttcttccaggaactgtcagttactgagctctgaccttagatttgtcatcttctaaaaactgatctgcaagagctctttgtatcttaagagaactacttttactattaatgcgtgacaaaatattctccccattgacttgatgtgctatccataagtatagtcatgaaccacataaccacattttggtcaacaacagatcgtatataacagtggtcccataaaattataatatcacatttttactgtaccttttctatgtttacatgcacaaatactcatggctgtgttacagctgcctactgtatccagcacagtgccatgctgtacacgtatgtagcctaggagctgcaggctacaccatatagcctaggtgtgtcggaggctggaccatctaggcttgtgtaagtgccctctgtgatgttctcataacaatgaaatcatctaacaacgcatttcttcgactgtgtccctgttgttaagtgaaacatgactattgctttttgtttaaagtcagtaaagaggcacagtttacactttacttacccatatatatgtatgggtgtatatatgtatgtattttttgcgacagggtcttgctctgtcacccaggctggagtacagtggcatgatcttgggtcactccagcatccacctccctggctcaagcgatccttccacctcagcctcctgagtggatggaaccacaggcgtgcactgccgtgcctactttttaaaaaattttttgtagagacagggtcttgccatgttgcccaggctggtctccaacttctagactcaagcaatctgctcacctcagcttaccaatgtgctgagattacaggcatgagccactgcacctggcctatgtgtatttatttttattgtcatatttatctgtttttttttcatgacttgtgattttgtggcatgtttagaaaggcttttcttgtttcaggattataaaaatagtcacctatactctcctctagcatttttattatttcacttttcagatttaaatttttgtttcatccagaattaattttggtcaaagagttcaatagggctacaatttatttttccctgaagaggcgggacagctgtcccaatataattcactaaagagcccatctttcctctgccaatctgcaatgccaactttactacaatgtctgcaacttaatctcaaatggtagagcaacaaacatatttagagtgtgtgtgtgttgaaattaaatcaaatgtggagaaatgttagcatagcaattattgaatcaagatagtacatttggccttcattacccacgggttctgtatctatctgcccattcaaccaactgcagattgaaaatactctggaaaaaaattttttaaatacaataataaaaaataatgcaaataaaaaccaatataacaactatttcatagcatttacatggtattagatattacaagaaaactagaaatgatttaaagtatataggatggtgcgtggaggttacatgcaaatactgtaccattttatcaaggatttgagtcttttcagattttgttatctttgggggtcccggagccaatcccctacaaatactgcgggacgattgtatgtagaagatcattacaccatccagtttccagttttgttttcacagtaaaattgtgtttaggccaggcgcggtggctgacgcctgtaatcccagcactctgggaggccgaatcacctgaggtcaggagttcgacaacagcctggccaacatggtgaaactccgtctctactaaaaatacaaaaaaaaaaaaaaaattagccggatgtggtggcacatgcctgtagtcccagctacttgggaggctgagacaagagaatcacttgaatccgggaggcggggggttggcagtgagccaagatcgcactgttgcactccagcctgggcaacagagcgagactctgtctctattaaaaaaaaaaatgtgtttaaaagtctaaaagaaaaggagcgttagaatggagatagagtctccactttcaaaatggatggttgagcaaaagttcctttcctgcagaaaaggcctggacgggtgtggccaggacgagctgagacccgatgagaaaggcagaagggcgtcaggcagggcttgcactgcaggaagctgctctggctgtccctgagtagagaagagagttgtgatgtgtggacaacaacaagacaacaagagctgttgggggcctccagctccagcttgaatgactgtttctattgatgtggagcagaaacctgtgggagccgctggcccctgtggacaagggcggtgaatgggccggcgggagcgggcagctgacttatggcgaggtggtgggtctggggtaggctgcggccttagggttggtggtgaccgtgtaccaaggcacacggctggcttccctctcacctgcaatagctgggccacggctcactgcccttcttcctcctgtcacaccagtcacactgagagagggccctgcacgtggtgacagcatgggctgaaccggttccatttgcccaagcaccagggacactcctttacctcctcaggaaggctcagctgtagaggaacagaaggaagatccgaagataataagaaggaggaaaagttggaagaagggcaggagtgcagagtgggccctccagggagggagggggcgagcgagcagccagccctgcccgaatcccccacccacaccctggccccgtcccagcagaactggtgacacttttcttcccagtgcctttcaaatttccagagcagctcagaattgctcagtagataacaggtttggggtttttatccttttcttcctaatgaccaggctcctgagaacaggagcagctgccatctgtagggtattcatcatcctcctgcaacggggaaatgagtcattttagcataaaatgtagaactgccatgaaattcaaattgcagtactttgacaagaattataatgtttgcagaaagtctcatctaggaggctgaagtggtcctgcgggaagcccccccagtcacctgagagaaacagctgcagtcgccagcaggatctgaccacctcgcccagggtggacaggactgaggccacctcttaatttttccaccctttttgttcctggacattaaataagacagagaaagcaggaaggtggggagagagcacccctgcaaataagagtcatcatccaagagagtatcaaccaagtaggcagaattcttgccaatttagttgactatgcatgggaagggaagtttctagggccttctggaaacagaatattttcttaaaggggccaccaatgataccctttggtcattccaaaatgacctctctgggcctgacgcccctgtgagacgtgaagccagctggacttcctgggtcgagtggggacttggagaacttttctgtcttataagaggattgtaagactcaccaatcagcactctgtagctaggattgtaaaacacaccaatcacctctctgtagctagcaagaggattacaaaatgcaccaatcagtgctctgtaaaatgcaccaatcagcactctgtaaaatgcagcaatcagtgctctgtaaaatgcaccaatcagcaggatcccaaaagtagccaatcgcagggaggattgaaaaaagggcactctgataggacagaaacagaacatgggaggggacaaataagggaataaaagctggcccggtcttcagcacttagccagccagcagcagcaacctgtagggttcttttctatactttggaagcttatttttttgctcttcacaataaatctttctactggtccctgtttgggtctgtgccacctttaagagctgtaatactcaccgggaaggtccacggcttcatttttggtcagcgaaacgaagaacccaatggcagcaatcaactccagacacatctggtcagtcttgttctagatccagggaaagcaatgccctaacggcaggagggaataacccttccagctgatagcagttgttcaaatagtagcaaaggcacataggaagtgtgttgccaagctgcagtctgacaattgctccaaacacgaattttgcttctaagaccctgtaagctgtgggttgtactcaaaagctgtaagttctttgtgcaaaggctggagaaggcagcgagcgggccacgtacctgtcttttcgcagagtgtgagaaacgagactgttctctttacgtggcaggacagttcagagtctctatacccagagcaaccagaacgagctccccttggagtcatggacccagtatctcagttgagcaaatggtaattttcaccaaggctggctggcattgggtgactttagtggcctgtgcacacgagcgccccaggcccttgggcagctgccagtgtgggctggggcttccttgtcgggagggagccaccctgcacctgtgggtgagttttgtctcctggcagcctggcaggcaggtgtggctcatggcagggtgagccactggcacggatctgctgctttccccaggtgagagtttctatgtgcccaaaggtcaccagaaactgacagccagccctgagcaaaccccagcccagggttcatgttgcccgagcagaacctgctggtgtggtctgcaggcgggggcgtttttcttggttggctaacactccttggaaggaggcatgggccaggccagtgtgcttagcagtaccccagagcagtgttgggggcgggagctcaagtgtggggtcagtgtgctcgcaccagagccaaacccaacacttcctgtctcttcctttcctgctgtcaggtggggctgttgttggggaaagaaaagcagggaggacagcgtgggaggctttctcagggccagccctgggaatggggcacagtgagggggtggcatgggtcacctggccccactaagggccagaggcgaggagagatgtccggctgggacttcctgggaggaaggggcgcgctgccacgcagtgcccgaggcccttgggtatctgcgagcatgggctggggcttccctgttgggagggagccacgctgcacctatgggtgagtcctgtcccctcgcagcctggcaggtaggtgtgccttgggaggaaggcacgccctgccacgcggtgtcgctactggctggcaactgttggagaatttattgaagcacgtgaaagagccccaccctgccatagcaatcacctgcctttggtgaggctgagcctggccgcgggaccccattgaccgctcctggcctcacactaaatggagttgcattgctcctccaaattccaaccaagaggaccgagaagttggcctgaagcaggcgcacacgtggaaaagaggagctgaagccacgcgggggctgctcctgcagaggaggtggcttggtctaacttttcaaagcaatggccactcggctgcatcaacctgcatgccacgttcctggctttgatcattgacatgtgcctggctctgctgctctcagctcctggcctcaaacttccttttgaagaaaatcgctgaagcttgtggcctcacttcttccaagaggcagctacagacactctccgggcctggctgcctgtttgttgggacggggcctctggcttgggtttgctgtgcttcaacgccatgtgactccgaagggcctcactcacgccagggcccagcaccggctcggggacaggccaggctggcatgactctgattctgcagatagcatttttagtgactctgctgggaattggttcctgagataacaaagccactgacacagggatgacagatggttaacagcacctcccgagagtaggtctgttctaaacacttgacctgtgacagagcatccatgccacgcggctgctccatgaagtagacgccatcatcgtggtctctgcaggtctacgatggggacactggggagagaggagtgactgtgctggagcatgcgtggatgaggggagggggaagggagggcgtgagcccggtggtccagcaccgtattgtcctgctccactttcctccgaggcttgggtgtgcacgcgctggagccctccctctctgggttggtcatggccctgtcctgtgagaggtggtgtgtggatacctcctgctcctgagtgagcccggcgctccgtaaggagtcagggaatggatccgccatgccagcccagccctgtgctgccaggagcctgtctttctagaaggtgggagtgcgggcacaggctgcctgcccagctgcagagttccctcctcaagtgcaccctggagtggggacggaggagcctagggcactcatgggctccaggttccctggctccctgccaccctcatggtgatctgtccttgcatctactggggtactcaagtaccccgggaggccttggagtatttccacctatttttccttcatggcctcccagtgtatgcttggggaaactgaggctggtaaggctgtagaacacatcacccacagcaagggccagaggggtacatgaccaggggaagaccaggcccttcagggctcatggccccagcccatggccacagagacagagagttttcacttgggtggacactgatgggtcctgctcccactgtgagaccgcgtccccctgccagctccacctggggcctaccctgggactgggaagttgtgttttaagtcttgccctgcctcagtgttccctaaggaatcctgcctggttatgacatgaagcacacgtgtggtgtcccttttgtgcttctggagctgttgccctgattggcatcttgagaagagtactggcagtcaggggatcctggtgcctgccctggctctgcccacctctgtgtgtgtgtcagccaatgggactctctgtgtctcagtttctcgtctttatttatttattttttgagacagggtctcactctgttgcccaggctggagtgcagtggcacgatcacggctcactacagcctcgacctgctgggctcaatcgatcatcctgcctcagcctcctgagtagctgggactacgggtatgtgccaccacacctggctaattaaaaattttttgggggagagccaggcatggtggctcacacctgtaatcctagcgctttgggaggctgaggcagttggatcacttgaggtcaggagttcaaaagcagcctggccaacatggtgaaacctcgcctctactaaaaatatttaaaaaattagctgggcgtggtggtgggtgcctgtaatcccagctacttgggaggctgaggcaggagaatcgcttgaaccttggaggcagaggttgcagtgaaccgagatggtgccattgcacttcagcctgggcaacaagatcgaaacttcatctaaaaaaaaatttttttttttttgagacagggtctatgttgtgcaagctggtcttgaacccctgggctcaagcaatcctcctgccttggcctcccagaagtttctcatttttaaatggaccctgacactggactgagatctcaagctggtatcccaagaactgaaccccataggaacctgcctttctgaaggaagttagagaaaggtgcttccccaggacatttggccctacctcttcctgtggtttgcagcccctggcacccacacacagcctggaaagaccccacattccctgctgagggtcgtactgtgtgctgactgtgcagaccattggaacttgtccttccctaggtaggtcagggtcctgtcaccacgttgtctggaggatagcaggtgctcctgaagtgtttctgaattggaccatatgcaaaatgtacatcaaacgagtcttaataacctattgctcctagagtaattgaattcaccactgttgaaaccccgactggcctgagaaattggctcaggtgaaggagactgaagacatgtggcacgtgcaggcaacatgggccctgcgctgggtctcactgaggggaagtgctctacagggtgtcagtgggtcaaatgtctaactggaatatgggtaggagaccagatgcatgcatgcatgttacatctcctaaggctggagttggaacggcagagtaaagagtttggcaaatcctctccctaaaaggtaacagcaaaactggataaaatggtcaaaaccatcattccaggactggaaaacagccaaaagcagacagcatgttgagacatgtttacttaaggaaaaaacccctgcatgagaaatggcatttttgcctgggcttctcatagccccacttcccacctcagttgtgtaaatctgctaggcagggcatgccatggagcccagcagctttactgccctgtggggctggctggatttgaagcaggaatagtggcaatcttgggaaaggtcaatattgtagctagcctgatgtggtaatctgagttgggcaaacatcggaccagtagactagccagaaatctgggagatttggagaatgagaaccatagtgggccttgataagtgcccacatgtccatggcagtctggaagaccaggtgcatgtgcagggctgtgcacaatacccaggagagactgcacagtccccgctatccattgagtcagccttgcatttgcagattcaaccaaccatggattgaaaatattaaaaaatggccaggggaggtggctcacacctgtagtctctgcactttgggaggtcaagatgagcagatcacttgagcccaggagttcaaaaccaggctggccaacatggtgaaaccctgtttctacatgaaatataaaaatcagctgggcgtgatggcaggcgcctgtagtcccagctgctagggaggctgaggcaggagaatcgcttgagcctgggatggggaggttgcagtgagccgagatggtgccactgcactccagcctgggtgacagagtgagactctgcctcaaaaatcaatgaaaaataataatacatggggtagtgggggagcatggaaaatgggaaagattaatgggtacaaaaatatagttagatacaacgaataagatctagtatttgatagcacaacagggtgactatagccagcaataattagttgtacattttagaataactgagggagcataattggaatgtttacaacatgaggaaacaatgaatgcttgaggtgatggatatcccatttaccctgatgtgattattagattgcatgcctgtatcaaaatatctcatgtactccataaatatgtacacctcagtacccataaaaatgaaaatacaaatacacaatacagtgtaacaactatttatatagcatttacattgtattaggtatgataagtaacacagtgatgatttaaagtctgtgagaggactgcacaagttatatacaaatactattctattttatgtaaggaaattgagcatctgtgagttttaatatctgtgggatcaaattctgggtcctggaacaaatcccctgttgatgccgggggttgactatatatctctggctgaacatgaggccttgtgcctgtgcagaggagatgtgaaacctgacagactgtgaaagctggggcacatttgtaacactgcctcaactccaaatgcattccctaaaccacacacaaatccactggcgaagcgtggaagccttagtggttaaaggtgtttaagtacatttgaccaatcattggctgaccacatatgctaacccacaggcaaccactagaggaagctagagttgaaaataacaacaacaacaacaataataaaaaccccaaactgaacagatacatcagtggctgcacactgaggttgagactgattctacaggatttgttcagtgaagtcactaaaacaaaaatacagcaacagtcccttgggggtaaggggaaggagcagaatccagagttgctacaatattacataaagtgtccagttttaaaaattatgagacatgcaaagaaacaggaaagtgtgatccctatttgggtggtaagtcgggaggaagctgggaggaagctatcaatagacactgtctgatggggcccagatgtttgaatttagtagacaaagatttcaaagcagctatgataaaatgtttaaagacctaaaagaaaccgtttcttttaatttgatgtgacttttttttttttcttggagtgacacagtctcactctgtcacccaggctagagtgcagtggcacgatctcggctcactgcaacctctgcctcctggattcaagcgattctcgtgcctcagcctccggagtagatgggactacaggcacatgccaccacatcaggctatttttttgtatttgtactagatacagggtttcaccatgttggtcaggctgatctcgaacaagtgagaggtgattcgcccgcctcagcctcccaaagtcctgggattacaggcatgagccactgcgcccagcccatttttaagagcaatgactcatcaaatacagactatcaataaaaagataggtattgtaaaaaaaaaaaaaaatcaaatggaaattctggggttgaaaagtacaataactgaaatatttagggtttaatagcagatttgatttggcaggagaaagaatcagtgaacttgaaaggagattaataaaacccatccaaattgaagaatagaaagaaaagaaaatgaagaaaaataaactgaaaaacagacctaaatttgggactcatcacgcataccaaatacatgtcatagaagtcccagaaggaaaagagagaaaagggaagaaatatttgaacaaataatagcaagaaagtcccaaatttgatgaaaaatacaccagtgaagcacaacaaacttcaaataggattaacagaaagagatctatagctagatgcatacagagttgaaggacaaagataaaatttcaaaacagcaaagaaaaaaaaaaaaaacccacaaccttatcacatacaagggaagaactacgtttaacagctgtctcaagtgaagaagacattaaaatgacatattcaaagtgctgtaggaaaaatatttattaaccaagaattctttagctagcaaaactatccttcaaaagtgaagacaaaataaacaaaaattgaagaaattcaatacaagcagatctgtcttataaaacatactaaaggaattccttcaggctgaaaagaaatgacaccagaagataacctgcatttaaccccagcatagtagaaaatacctatatttcttatatgctgtatatagatattttctagtatgcttttaattccttttttattgcttcattcttacttttttgttggaattggttgctctaggaataaagagagcaataaaggagaaagaagaacaaaaaagcctaagtcatataatctttaaataaatagagaagtggcaggaagaaattaaaccataacaatagttagattaaatgtaaatgggattaaacactccaatcaaaaggcagaaattgatagtaataaaacaagatccaactacatgttttgtataaagagacaccatttagattaaaagacacaaataccttaaaactaagtaagaatgaaaaaagatataccatacaaacagggaccataagaaaatttaactgatattctaatatcagttaaaatagactttaagacagataatattgctagaaacaaagagggatatttcataatggtcaaaaggaagatatagcaaatataaacatacatgtttctaacaacagagctccaaaatatgtaaaacccaactgacagaattgaagggagaaaaaggcaatgcaataatagttggagccttcaataccccactctcagtaactgagataactagacagaaaacaagcaaggatacagaagacctgaagaacagcagcaaccaacttgacttctcctctatctataaaaaaccccacccaacaacagaatacacattctcttcaagagcacatgcagcattctccagatagaccttgtactcgaccacaaaaaaggcctcaatgaagaggattcaaataacacaaagtatgttttcacatcagaataaaattaattaaaaacaacagaaagatatttgggaaagccccaaatatttgaaaattttaaaaattacttctaaataactcaggggttaaatcacaaggaaaatagaaaatattttgaactaaatgaaaatgtaaaaatatcaacatttatgaagtacagctaaacagtatctagagggaatttatagctttaaaatgcctattttaaaaatatctgaaatcactaaacccagcttcctccttcaaaaattagaaaaagaactgaacccaaagcaagtagaaggaaagaaataataaagactagcgcaaactccacgcaatgaaaaacagagagccaatagaagaaaatagatgaagccaaagtcaattcttgtaatgctttctgaggttaagtgtagtgtagttatataagagaagactcttgttcttaggtaatatgcatcatgtcttcaaccttatgctcgaatgattcagaagaatattgttatgggcagaaatgtttatatcccttaaaattcgtaacccccactgtggatgcatttggacatggggtctctaaggaagtaactgaggttgaatgaggtcctaagggtgggcactgatctgacaggattaggatcctcatgagacaccagagggcgtgtctgctctctccatgtgcatgtatcaaggacagcccactgaggacacagagatggtggctgtttacaagtcaggaagagaacccttaatagaaactgaccatgctggcaccttctagcctccaaaacgatgagaaaataaataaatgacagcacaaactgcaaattttccaaggaagcatcttggacctgatctaagccactcagtttaagccactcagtctgtggtattttgttaccgtagccccagctgactacatacctacctacctagagtgcactgcacaggtggaaaattggcaacactcagggagtctaggtcaagggcagaagggaagttctctgtattattctcgcaaatgctgtgttgttgcaactgagcgtgaaaatatgctaaaaaaaaataaaaactaacctttcccctgcctgggtggtggacacttaagttgctgggctgtgatgggctggaggctgtgctctcctggttccctgactgaggtgagggccttcggtttagtcctgccctccctgcacagggttctttttgcctctatcccactaagtcgtcaagacggtggacgcagatccactttctgcttcctcctggtgcctgccctgtgtttcccgtggtcctccttggaaaggccacaaaagtgtttcaagaggactcaggtccaagatgcttccttggaaaatttgcagtttgtgctgtcataaatgtggcacattaatggttgctaaaactggggagcaactcctcaaggcttggtgggagcatttcaactgagtttaaatattcaaaaacataagaaccaaatcctgtcccccaggggcagcagcactggatcctactgaccaagcttccaccctcctccctgggcctatcaagaagaaaccaatgggccggacacagtggctcatgcctgtaattaatccaggcactttgggaggccaaggtgggcggatcacttgaggccaggagtttgagaccagcctggccaacatggtgaaaccatctctactaaaaatacaaaaattagccgagcgtggtggggcagtgagccgagattgccccactgccctccagcctgggtgacagagcgagactccgtctccaggaaaaaaaaaccaatgaagccctgggactgtttggtgcatgtgtcctctactgaagagcaggctgcaaagaaactcaattttgctttaaagcactcggtttcaaatgtttctgaaagccctcagcttcccactacaacggcaaccgctgcttggtaggtatcaagactggggctgctccctgggtctcaaccttcatgctttccacttggttcctgctcatcttcaagctgtccttatccaacatggaagacactcattctcagaagtgctctgggaaaccccatgtcctcaaagtcctctctaggaaccccactgccgtcgttccagccggtttctgccacacccccactgacaagaaatgaagagttgctagggtgaatacttggcacgcccctcaacactaaacagcagcagcatactgaccacatgtcagtttccacattttctttccttctctgtttttaagggggtatgaaatgatttatacctgcatgttttcaaatccacttaagaccaggaggtgctatgtggacaaatagatcaaactacctcaaaactttacggtgacaatcaagccaaggtaaaacacgctaaaatcaccacctgtgcacccacctcttcctatttttccgcgggtgagtgccagaggagggcgttccacatgggggctctagtgcgtctcacgaggtgcacttctctcatgcaccaagtgaaaaccttacacatcttccctgcctggcattgcgccagtaggcagaaaacttggtgcaacaaaactcaatttttgtctttattggcacgtggtttcctagacaactatggacacaattccctcagaacagcctatggtgcaaagggagggaagggagagtgtcagaatgtggaaggcttgtcgtagttggttacagacctctcttctgagcaccttgtttgtgtcaacttctggctaacctgaatgaacacccatcagctgggagaaacaagcactagggggcaccttcatggtcactggtaaagaaagccctaattatctacaaaatggaaatggaaaacaaacatttaaagttttatgcattttagttttgaactagaaatcttccaagtttaatatataccttcctagtgaattcccctgccaaaaacaaacaaaaaacccctcccctaaaccaaatggtattcctgcatcttgggcaacagctccttcactgtcaagtagttccaaaggaaagcacgagtaggtaagagtcaaaaatgccactgagtttttgctgtgatcaaattgatcaggagacaacaatgtggttctgtaaaaatcagcacatcaacaatgtgtcttcccacactccatctggggaaacccggctaagcagcctggaaacagagtgccaggtcactctctacatgtagggctgctgggcagccgcagtaacgtgtgcccggatgcatctgtgtacacagctctctggtttgctttctgcaaattggacggaaaacagagcctggcttcccatccagtaaatggttttcaaactgcgagtcaagaaaaccgaaaacttactccccatctgcctgctaggtggccttcctgcatttactgccacatcccttcctagccaactgctccctgtctagacggaagccacccagtgtcaacgtctgtgtctcctcacctgagtcatctccatctgctcagtgccttgtgtactgcattaagtacttgctcagaggtcaagaggaggaactgactcacgcagcattagtggatgttcactaagccttctgttgattgtaacgttagtataggggaagggcaaaagcagaattctgaccctaaagcttggccatctgaatgaactcactgcaccatgctcagtgctgtgggaagatggttaggcaacagaaatgtccttaggaaggagctctaggtatctacacctgaccaggtgttcatgccacatactaaaaggtagggggacaaaaaacagacttactgagttgtgtccctttcacaataaattgtttccctaatttatctaaatgaaaactgtcttatttaggccttatatatgtgtgtctgtgtttacaataaggacacatttaaaacagaaaactcaacacctatatcatactacacataaagttaactcaaagtggatcacagacataaatataaaacaaaaaattctgaaacttgagaagtctttacactttgggctaagtgaagatttctcttaggatagaacatcttagtgaagatatgacaaaagcataatctatgaaagaacaaactgattaaactagacttcatcaaactgaagtcaagcgaaatgaagtaacgtttacacaaaaacctgtacgcaaatgtttatagcagtttactaataatctcccaaacctggaaacaacccagaagttccttaactggggaatggataaacaagctctggtacagccacacaatggaataccacctggcaataaaaaagaacctgcaacatcatacatgaatctcaaatgcatcatgctaagtgaaataagccagactcaaaggcaacatattgtatgattccatttatatgacactgtcaaaaaggcaactatagaaacagaagagatcatcctgccaggggctggaagaagggttgagtataaaggggtacaaatgattagagaagataaagaaactgttgtatgtattaaccgtggtaaataaacagtatgtgtttgtcaaaatttgaactatacattttaaaaacagtaacttactctatgtaaattataccttaacaaagatgaaaaaaataaaatccacatagatggattcagtccacaaaggtgtttactgaaacactatagcaataatccaaatgtcaacaggggtggcagttaagtaagtaggatgtccacaatggaatatttatgctcactaaacccattttcttcccccaaatgtgggtgacattaaacaatgcccgtgctatttatctggggaataaaaccatatacaaatggttacacgcacacacacaaacgcacgtgtgtccccatgcaggggtgtttctccacgcaggggtgtgtgtttacccacagggggaagtcggcctgctgccttctcccactctgtctccaggtccttctgccccacttcagtctgagcccttcagatgagcactgcccacccatctgtacatgctggccaaggggagaaattctgcatgcaacaccagacgacgaggtggtaggtgacgctgggtgatagggatttgtgtgcaggattttaaaacaggattataaagctgcatgaaactagaaaacagtgggcaaacagaccaagccagcactttattttaaaaagttttattttggagatttagaaatttgagatttttaataacggcaaaagaaattcagtcacacctaatgattaacagaatgtagtggtgtattatctaaacagaaatcgtgctgatgtgccataataaattgtctattagtaaaaaaatacactttagggcacagcattgtatcacaaattacagtagggatactttgcaagaatttaatcaaactagagaattctgagtaactgtatcttttaaatgcagcacttaaaaatgtaacaactctgtgcatcctttttcttaaaaaaaatgaccttgcatgtgtcatagaaacgctgctttattgctgcagaggtcaaagttcaaggctcaagaggtacaggagagaatacaaaggtagcctttagaaacgtggtcttgtttatgtataaaaaaggtaaagtttataaaagttaatttacaaaccaagaacaaaagtggtatgcacgcattatgtacaagcatccttaaaacatcaaaattttcaaatgcatagccagaaagaacagaaaaccaccactgccccttgtcaaaaaaaaaaaaaaagaaaagaaaagaaaagaaaaaaatatccccaaatcacaccactattttcttctgggtgataacacatttctgaaaccaccaaatgcacaacgtactcagtctttgtcatgatacagtatctagataatgcacaaaagccataaaaacttagtaacacaaggagaatgagctaagaattaagaacatgagggtaaggcatttctgctggttagtatgtctgtggtaatatggtgaagttagagatctgaagaggccatggaaccagtctcacatgcttttgtatccttccctaagaaaaatgtgttttcatgtacagtaagtcattgtcttcacttcaccctcccccagttgtaaatctccttgctgtacatttctgttaaatccacaacactggttatatattccaggtgcatttaaaaaatgtgtgcatattacttcatgcataataaaataaaatgtgtacgtatgctaggccagggccatagtaaagtttgaaacagtgtactttggaaagaacagacctcaaatgcacccccatttactggctggtattttaacggaaatcaatatgtgaagttaagcagtgacgataaaaaaattacaaaaatcacaaagcaaaatatctttgaacctctagccaataccaacagtcccgtcaatcacaaacatgcagtgtgtagcatgttttccgaccatggttcaggggcatgctcactcatctttatcagttcaaacaaatgcctcatactaacaaactgtagtatcaactctaaaaaaggtataatacttgatagagtggttccatttagattaagtttaatccagtttcacattatttaagttcctatatttcaagagttaaaagtggtcaataaggacagaaacacagtttgctccaacgagataatttggatctccgggaagacacttgttttgccaggttttaggatcacctatgagagaaaagaagttgatgtcatttacagttcagtaaactgctatccgtaatgctttgcaattatagggcaaatacgtatatttagacataattttcttctgtttcttcagcatattgaatttgtatcaaaacacattgctgtatttcaaagcagatctgctggcatctaacaattccaaaggtgtttcacacttctaaaaaaattttttttaaaacgttctttctaactcacaccattaagaacagttttttgttttttgtttttaattttcagacttctcctttattacattatcaagtgcattggccttttcaaaaaatgaatacaagtgagtgatggcaatcttatgcctgggacagtcccagtttgccagagcccacataattatcagtagcactttttttttttttccagtttcgaaagtctggaggataattatgtgatcacctatttgagctgagaatgaggacacatttctcacactcaactataaaccaacaaatgaagcccagttctgcagaatctagttcttgaagactgtcttcccccttacaaaaaacaagcaaaaaaacgagactgcaccagagctgctcagctctgattccagctggacaacaaaattaatcatgcagcttcaaaaactcattgactgggtgttagttaggtctcaggatttaagtttttaataagctcttggtgatttctattagatgtgaaggcagggacgactatatgtctctgtggtgtccaagcaagctgagagtcacagctgtggacgtttgcttcccttacagaagtagctctcaaacaggaatgaccctgcccctgatgggacatctggagacagttttgcttgttaccactggcatctaggggtagaggcccagggaagctgctaaatattccacgacgaacaggagggccctacaacaatcatttggccaaaatgtcaacagtgccagctgagaactttgcttacagtacgttagacattacctaagcaatatctggagccaaaagcatttcatttttccagaaaatggggtacttgtaaatatgaggaaatatgtatttacatgtaattttttcctctgataacattaaaatatgctcttgctataatctttagaccacaaacttttatttcatactgtaccaaactaaaactaaataatgctcatctgatttatcaaagatttggaagctagactttaaatcaggttcgcttaaagtgatctacacccaaaataaaattctaattattaactgacttaagtcactcaaggaagtgagaaatgtgaaaatgcagtggaagctttgaaattatctcaggagaaaaagtcatttacaaatagtgtataaaagaagtaatttagagtattacactgaaaaaccatggccaagtatgatcacaacggaagatcttgttaagtttctctggtatacatacgttgtagattaagaaattaaacaggccaggcacggtggctcacacctgtaatcccagcactctgggaggccgaggcgggtggatcactttaagtcaggagttcgaaccagcctggccaacatggtgaaaccccgtctctactaaaagtacaaaaattagccaggcatggtggtgggcacctgtaatcgaggctgaggcaggagaatcgcttgaagctgggaggcgaaggttgcagtgagctgagatcgtgccaccgcattccagcctgggcgacagagcgagactccacctcaaaaaaccaaatcaaaacaaacaaacaaaaaataaattaaacaatagtaaccaaaaatagaaatagttatataaaggaacaaagtcattttaataaggtaaaaatgcctatttgtgcaggacaatatctcccactgcatcctgaaaaatttgacagaataaatcatttttctgaacaccaagaaatagtcaatatttggccatattatcaaaaaaaaatttttttgagacggtctcgctctgttgcccaggctggagtgcagtggcacgatcttggctcactgcaatctccgcctccctggctcaagcaattctcctgcctcagcctcccgagtagctgggattacaggtgtgtgccaccacgcctggctaatttttgtatttttagtagagatggggtttcaccatgttggtcaggctggtcttgaactcctgacctcaggtaatccacttgcctcagcctcccaaagtgctgcgattacaggcatgagccacggcgcccggcccaaattatcaatttttaaaaggcagaaagtcttctacctttccatatttatttacaatatatgcaccacaaataaatgtgaaaacactggtgatgcctacaaggccacaggaacagagatagagatttgctaacacacagcatgggcagcatcatcagcccaggtattaatcaacgacagtccccaaagctcccaaaggacagagtgaagacagcatacccgacgaggagtcggatgattttagagcaaaagaccaaccgtcaggagtcatggacgcacagtgtggtaagcgcagctccacaggcttcaggaacttgaggccatggggaccacacatcaccaaaggactcagcagtgtttcacctggagttggaaaaggggataggcagagaggatggatgtggtctttcttctagaatcccagttttcctcaccctgcttctaattatatgcttgaaagcctaatggagttagttctctacagtcgcactgaccacaaaaaaacgtaacagcagccacatatggaatcttaaatttcccagtagccacgttagaaagtaaaaagaaacaagtgatatcaaatcttacaatattttaatattttaactcaatataacgaaaacactgttatttcaacatgtaatcaatatatgaaatctttggaacttggtgtgtatttcacatttccagcatctttcaatcccaaattgtcacacttcaagtgctagctagccacgtgcaggcagtggctactgcattcaatcatatgggtctataataaaaaacatattcaaatgtgcttgttgcgaatgtgatatattttccattttcaaaatgttttgtttgctccataggtggttaaagagattcatgcagggccaacacagtcagtcctactggtttttaaaacaggatatccccaaaatcagagtacagaatcagatgtcagtattccggcaaaatacaaaaaagcgaactaaatttgtttaggaagtaaaagcactgctaaaagatgctaaatcacaacacacttcgttataatatcctggtagatccaggaggattatgaaaataagtttccttaagaagctcagaaacatgctgtcatctcctctgagactccttcatgcactctgctgagcatgtactagtgctaggttctggggtgatgaataagacagtacctgtcaagaggtttaggttctccaatcaggtgaaggcacagcaaagcctttctgagtgggtgttacctaacccatctccagagacgcaaaggctgactgattcaaagacaaatttggttaggtcagcctaggctgctcagcaggtgagacatcccgtggcctgtcctatgccatcattttttatttcacaccaaaagtaaaagcaggcagtgtggtcaccacagccttgcttcaggccacccactgcttgcttgcaacaccgtccccagggcacccctcgctacagcactcatctggagatagagaggtgctgcattattagccaagcactataagctctgaagtgcacacagggcaactcttaagttatcaaaactaaggagaaaaataaacacatttacctttctctttatctaaaggtggaaggatgctgttgtcccggcagaccttgaaatagatttcctgctcaactccttcgggaatggctccttgagggataattatactaacaccagtttctatggaactcagcacgcccccattgctgttaaatatgcctcgggctgtggccaccacagtatgaccatcttcatcttcatcctcttccacagctgaaggactgaaagttcagaaatggctagtgagtgaattcctaataatacacaggtgctttgcttttactactactgtattacgtgctttcacttttatttctccatataatcaagaagttactttaacaagataagtttctggcaacagattttactgacagggttatcgcagagaatattatttcttttttgtttgtttgtttggttttgagacagagtctcactctgtcgcccaggctggagtgcagtggcacaatcttggttcactgcaacctccatctcccaggttcaagtgatttttctgcctcagcctcccatgtagctgggactacaggcgcacgccaccaagcctggctaatttttgtatttttagtagagatggggtttcaccatattggccgggctggtctcaaactcctgatctcgtcgtgatccacctgccttggtctcccaaagtgctgaggttacaggcgtgagccaccgcgcctggcgagaatattatttctagagaaattccattctagaaaatttcaaaaattctagagaaatgtcaaaaattcaatttttgaaggcaattagtcaaacgaccttcattaatgaattgcaacctgaaagtgtaaaatctgatgccttgaacacccaactacaggtgaagcatccctaacctgaaaatctgaaatgctccaaaatcggaaacttttttttgagtgtcaaaatgaagctcaaaggaaatgctcattggagcattttggcaatattccaaaatccaaaaaaacccaagatatgagacacttcagaacccaagaagtttggacaagggatactaaacaggtacagagttttatgaagcacattttaaaatccatgaaattggaactttaaaactggtaagtcacaatttaattggtagccctgttcttcccttcctgttgttttttgaaatggagtgtcttgctgtcacccaggctagagtacagcggtgcaatcttggctcactgcaacctccacctcccaggttcaagcaattttcctgcctcagcttctgagtagctaggattacaggcgtctgccaccatgcccggctaatttttgtatttttagtagacatgggttttcaccgtgttggccaggatggaactcctgacttccagtgatccgcccgcctcaacctccgaaagtgctgggattagaggcatgagccaccgtgcctggctgttcttccatttttagtgacacaaaacaatggtgcatctcacggctgacagcatctcagacttgataaaatctccctaggattttaagtgtgcctgagtatggtcctgcctcagcattccctgaggaccaagcgcccgctctggctgtaggaggcaaggcttccaaggttccatgaggcgaagacccttgtatgggcatatcccaaacatccacgaaagagagacagtagattaacttagtaatcacagaacgccaaaggcaaaggggatgtggtatcaatgactgcttcaaaagtagaggctatcaacttcctgaaagtacagttttgagccagggctcaaaggtgagcagaaagaccaacgaaacagaattacatgaaggtagctgccgtttcactccagcatgaccggagtgccagggacgacatcctacgacacaacatcaagggagcagagcgcagcctgagctgcagagcagaggccagctctgtccgcccctgaccatctgtggatgtgcagagctaggaaggcagtgaccgccataaccatcctttctcttggaaagcagactcaggtggccatcctgacctttggttctccctgcctgcaagtgcttctgctttatggtggcgtgaaaatggaactggctgtaggaggctgagatgagcttttatgtatggccagaatccatctggtcaatcgccgtggaatgaaagacaggaaagaggagctgcagggaggctccaggtgggctcactttgtctcatttgctcagccatctcactaactgctgctctttaaacagtcagaggttattctatttttcttcttagcatcattgtggaacaaataatgaatgaggaacatagatacttaatgtttttagatgtcctccacatgcaccttaccagtaggtcaggaggttacaaaaggtcatggctggttaagagtatgggctcctggctgggtgcagtggctcacgcctgtaatcctaacactttgggaggtggaggcggatggatcacttgagatcagaagttcaaaaccagtctggccaacatggtgaaaacctctactaaaaatacaaaaaatttagccaggcgtggtggcacacacctgtagtcccagctacttaggaggctgaggcaggagaattgcctgaacccagggggtggaggttgcagtgaaccaagatcgcaccactgcactccagcctgggcgacagagggagactcttgtctcaaaaaaaaaaaaaaaaaaaagcatgggctcagaggtcggatgaccagcagctaaattgaggctcacctcactctagctgtgaccctgggcaaactgcttactgtcactcaacctcagttcttagtaaaacagggatgatgacaatacctaccaaccatacacgactgttagctttattattttaccaacatcttgtacctcctggaggaccttctatgtaacagcattcattgcaacaacactcttcagtttaaaggttgagttaaaaagatcactttaaagtcccaagtcaaataaactacaacaaactcacatgagaaaaatcacagggccaatgctttgagcaaaggcataagtcttacctcacaggaatagctttaggcactgtgctgatattatttatttgatatttaggcttctctgcatggatagagaaagtttcaactccactgtcaaactcaggaggctgtgccaaactgtgcgatttcacaagagtttttggagaagtgggagtttttgaagacaagtcaggtttatgtgcagtttcacttggcagaagattgtgattgaatttaggactttcaaacttgcgttcaaatggtcgggcagaacttgtatatggttttggtgtgaatcgattgtatgctggagtgactgttttctgagtctgttcagttccattaactggggctttatctggaaaacttttctggggatagaaagctgcctgagcagtatcttctcggtttggtggtctgaaagttgctggcttattctgagatggaggtgggtctggtttggacactaaggaattctgaaaatccaatgacactgaattacctgaaaaacaaacgtaagcatttaaataactttctgaaaaaagttataatagccctgtcccagcttaacttgtcctggtgctggagtcgaggcccaaatgtgggtcgcacagccagagcctgactcttgagccctggaggctaggtgtgatgctgagggatgagggcagcatggacaggtggtgccatgaatatatataccctgctgccctggagtcagggtccagctgctaagattcctggcctccaaagattggcactagtctttgtgaaaactagaatgcccaataatcatataataaggatactcactattaattagaaaaatgtaaaacaaaaccaacaaaaagcattaaatactatttcacacccactagaatggaaaaaccgaaaagtctgatgatgccaaacattggttaaaaagtggaaccacaggattttttatgcactgccagccacagtgtaacacagtaccaactgaactctgtgaaataattaaggacactacaagacaggagaattattaatccaaatacctcatgaatatagtaatataattttccacagtacgagaagaaaaatcatatggtcatcttaatacatgcaggaaaaacatctgactgctttcagcaaactctgaatatagggaatgtcttaaacatgataaaggacatctacgaaaatcctagagctaacattctaaaggataaaacatgaggtccttcctccttaaaatcaggaactagcaaaagaggtccaatttcaccacttacatttcagagtttattggaggtcctggccagtgcaatcagcaagaaaagaaagaaggctaggtgcggtggctcatgcctgtaatcccagcactcttgagaggccgaggtgggcggatcacctgaggtcaggagttcgtgaccagcctggctaacatgatgaaaccctgtctctacaaaaaatacaaaaattagccgggcgtggtggtgtgcgcctatagtcccagctactcaggaggctgaggcaggagaatcacctgaacccgagaggcagaggttgcagtgagctgagactgcgccactgcactgtagcctgggcgagagcaaggcttcgtctcaaaaagaggaaaaaaaaaaagagaaaaggcataaggactggaaagtaagaattaaaactgtctttatctgtaaacatgggcatgtgtgaaaaaaaatcttaataaaagatagcctcaatccagaactataacacatctgcttgaagactcacaagcccaaggaggtgcctcctaagggaataataagagaagtctgtgctaggaaaatgcctgtccacagcagaagagataaccactttgtgttatatgctgagggtaaaatgttacaaagctcttaagatgaataatctggagctatatgtgatctacctggtatgtaaatgcaaaagtcaaggtgtatgggatacattttatatgaaacattatggcttttctatttgggtgtgtgagataaaacatagtaggttttacaaaccatctttacatatactggcaaacactacttccagaagatttagagactagcataaaatagattaaaatctgtttagctaaaaggcttgtccaaaataatggtcttgtaaaaacaggagacatacttttaacaaaattcttagtttttactgttcccagcccaaaggtttcaagcatgtattttttaatgtaaaaaccattttgcctagaaaccaccagaattttacttcataagcattactgtgttaaaatgtctacttccgaacttcctaccttcaccatgtgctcccttagaatgtatgtggagagacgcgctggtgacaggctgagatggctgggcatactgcgagggcaatggaggaggagggggagtggcctggatgggttcatagcgtttctcgccaaatgatctatccacaccatcagcttcaggaggctttcccctgttaacaaatgaagaaaatgccaacacctgaaaatggactcacatttacaaaacaagttctcatttctccatgtatctctaagttaaaaaaaaaaactagaaatttcacaatttattctcatgagtatgggtagctactctaccaaaatataaaaacagattcgaccattcatcggcacaagaaatgtccagacacacaaaaactttaagaatattagtaaaacatccagaagatggcaaccaaaggcaggtgaaattttgggtatagtttaattgttatttacaaaagatagtaatgttgacagatttaagaaagtcttgcaaatattctgaaaacatatcatggcacaaattttcctgagacccactttttttgtttttgagacagggtctcattctgtcgcccagactggagtgcagtggcgcgatctcagtttaccacaacctctgcctcccaggctcaagtgattcttctgcctcagcctcccgagtagctgggattacagatgccagccaccacgcctggctaatttttgtacttttagtagagatggcgtttcaccacgttgtccaggctggtcttgaactcctgacctcaagtgagccgcctgcctctgcttcttaaaagtgctgggattacaggcatgagccaccgcacccggccctagacccacttctgattttgtatctggcatctggcatactcggagcaccataaaaacagatgtcacagactaggggttggcaaactttttcactgaaacaccagagagtaaatgtttgtggtcttttggcccatacagtctttgttagaactattcaaattatgcggttatagccttgaagcagccacagacaatgggcatatctgcgtttcagtaaaactaaaaaaactggagcttttactttaaaatttccccttgagttaccaggtccattttttggttaaatgactgctagagcagcagatcctgctttattttacaaggttcatttaagtcaaattgtgccatgtatgtttattttttcagattgccaattgttaatatgtaacacaaaattcacacaaatctttttaaaagacccataattgcaacattgccatctaaaccttactgctgaatgccaaagctgcactagctttatgtgcaccaacaataacatatacatttggaatactcctggtcattttcataaattttcattgaagaagtcttatgattggcttttttatcttgctttcatgaatttagactaagcccttgatgatgacattaaaatctgaaagtgcacataatgccagtgacacagtgagggacaccttatggaacagcctcacattaattgccagtcttaccacttgacgttccttttcaagtagtcatagctagtgtaagagccaagaaatctaggtgatggcaaagcaagcgcaatagaaaaatgaaagaaaatggtcaatctaactaagtaaatttgcagcaaatggaactcaaatgtcatttaaaaatatcaaccaacatccaccatttcaccataatttggtctataaaggaacatatcactaactctcatttggccaaggaaattgaagataaataaaacacaatcacttagttatgtcccgtctgctggcccatccttcatgtactttaactgttactgcagtgaaaagcaatgtgtttgaactttgctccttctccacctctgttgcagctgctaatagtgagcaaagaaatttatcaaatcaaagagtggtgatcaaggataattagcaggttctgaataagtgggagtgacatgtcccattaaaaaaaaaaaaaaaaaggctgggcaaagaaattctgcaagtgaagacacaggaaaaagtaacacaacagaagagctacattgagcccctgggaggggaatggtaaatggagagatagaaatatgcctggcttgaaacctggccaggcttcacatgttcctttctagcaagacctcctccatctccaatcgtaagctgggccctgtggtggtggagtcttactggtgaagctgcatgcttgatgctcaggctctctctcatctaatgatgtctcacaaacacaaaaacaactgaacatcagtctctcacatttagttctttaaaagctacaaaccaccatcatttattgagacctggaagtctcacatagtgagttgagtcctgaaaggtagatttgataacaaaaaatccctggttgtcctgaagaagttgactcaatctctggactgagacatgtgcacagccctggagggacactgctcttcttgcactgttttagaatcctggaaacttctaatttactttggaggtgaatgtctaagctactgtctcctaacctttccagttctaatccagctctatggaactgttagactgggtaatatctgcttgcttcctggggcatctgtcctgtgctaacaaagattattttccatatctaattctcaccatttctgaggtgtgtttttaagtgaagcataagcacacatcatctgaaggaagaaaattttgctactcctgtatttactgaaagaaagaaatgcctgaaggcagtcttatttagtgacaaacagtaaatggttttgaaatgcaggacagaatcctatattttaagctattttccagttgatgaagttgtactcattggacaagagtatgaaaaagcattacaagggaaacttacagaaacaactaccctcttagttatcttccatgacccttattctcctttccatttctctaaccattaaatacctatatgggaaaatgcagcacaattataaagagtttcaatttcacactacaaaggaaaaaaaagtatactggtatccagcccaaactatacttttctctctcacagcagcagggagtaaaatcaaactgagttctgagtaaattcacaaagacagatgtcatctgtttcacaatatatccctgtgaaaacaatgaccaggtaatacaggttccttccagagctgtgttaatgaaaagaagggtggtggatgcacctagtataccatgccctgttttgagcttcattcactcaacaattactgagcccctactgcatgcaaggcaatgttctacaccctaaagttatacatcacaaataagctaagtcttctttctagaaaaacaaattaacacagaaagcaaacatgcattttgattgattccctggcaaaacaacttactttttagacctaaatatactcctttttttttttgagatgagtctggctctgtcgcccagactggagtgcagtggcgcgatctcggctcattgcaagctccgcctcccgggttcatgccattctcctgcctcagcctccagagtagctgggactacaggcacctgccaccatgcccaggtaattttttgtatttttagtagagacagggtttcaccatattagccaggatggtctcgatctcctgacctcatgatccacccacctcggcctcccaaagtgctgggagtacaggcgtgagccactgcgcccagcctttttttttttttttttttttgagacagagtctcactctgttgcccaagctggagtccagtggcacgatctcggctcactgcaagctctgtctcccgggttcacgccattctcctgcctcagtctcccgagtagctgggactataggagcccgccaccacgccccgctgatttttttgtatttttagtagagatggggtttcatcgtgttagccaggatggtctcgatctcctgacctcatgatcagcctgccttggtctcccaaagtgctgggattacaggcacgagccactgcgcctggccatataatctttttaaggttgtattctatttaccaaatatgtaaaacgataaataagagatatctttaaactaaacacctgagccttcttctgacaggaatgaatgtgtttaacggtgtttagtaaaaataataactaaagggtacacccttctgccttaccaaaggtgagctcctatggctcagtgcctagctcactttaggctagtcaccatttagatgttactgtgataactgtgtaaatgaattcctgtaacactgtaaatgtaaatgaattcctaatgacaaatccacatctgtttttgttcttgtgggttttgttctgttgaggtatgaacccagctgtgcacctgtgtgggtttatattgtgctagctcacttcagtccagacaccatctagatgccacaacccctttctagtgttgtgctaaggggtggttcacaacactagtacaagacacgttttgcatttaatacaacccccactgcagcactctcagtttgcatttggattctcataaactgctttcttctgtaaacataaagccttaaatataggacagtgaaaaaagtcttcactacaaaggatgtcttagaaaaaagcagtggtaattaaaattaggttttaatgttagtggttttaaagtatgttctaaaacaatttacactcaatagtaaatgacaaataggtcatttcccaagataatcccaagcccacgcaactaagtaaggaaaaatctaggtgcttttaatatagacacaatactatgtgtgatgaattctaatatgtcaatctggctaggtactgccatgaagggatttttcaggtgtaatgtccccaagtcagttgaggggagatggtcttgggagggcctggcctaatcagcagagccctctgaatgagaatttaggccttccctgatctcacactccccagtagctcaaaatcttcccttcctgaccaactgccctctgaaataggacttgcttagccagcccctgtaactgtgtaaatgaatttcttttgacaaatccacatctgtttttgttcttgtgggttttgttctattgaggtatgaatctacctgtgtgcccgtgtgggcttagacacaactatcagtaccaaattctcttatcagtcagggttcaaccagagacacagaaccagtaggagacacaaacccacgcaggcacaagaaaggagaacaaaccaacacgaaacccagggatgagtaaacggaggggagcagcaagcacagggaaaagatgactgggagtcaagaaacttggggttcagtcccagctctgccctgtcattttccctcacctgtaaaactggatcagaaatcttacaaaaacaaaaaacaaaaaacctcttcagtatttccctcaaacaggatcctcctcacatctgtatttatatttaaaaaataaaaacagaaaagaaaaagaaccagcatgacatcattaggtgtgtgtacagaagtgaagactgatgattacctatcgatgagggtccttgtggttgacactgtcttccgtcaaaaccctgtgatgttagcatctttgtgaatgcaaaaactatgtacatctaatagcagactttaaaaacaaaacacacatcccagaactaaaaagtatgtacaatgctgaaccactagagcctacagaaatcatatattacacttaaattatttttcttcaaaatatattgaactgcacgggattaatatgctgcatcctatttttaaaagccaggtgaaatagcttactttgaagaataactagaaaaatttgattgattctgagaatgcgctggctttgcaggctcggagagatggctggcggcaatgtgtgcaggaggcttattctcaaaacttcttcggtcaaagtatgacagctgttttcgataatattcttcatcttcttcagggtcataatgattggaccgaacaatatcttcaggtggcttcagttgaggtttttgaggttctgggatcctaacagataatgaatgacaaacggaacacctttttaaatattaatgttatgaaggaagtagaatatgtaagtcttatcttgactaaaaggtcaataattactaactgctgtgattactgaggatctgagcagtcccaacagttaaaatggatatttcaaatcccatgtcctcacagagtatactcaaaaggcagcccccttctggctcatgagtcctttaacacaatataataagctaaacgattacatgattagggaacagcaggttagaagtagttaatcagaaagacaaagggcaatgtaaccgagacagtgaacatcttgagaagtacatataccaaggtcaagaacagtaaatgatagactttaagaactttcaaagggatttttaagaactcagtccaggatctcaatgattctcatatgaacaaataactctatatggtctaaagttctagaaggcatacaaagcagatgaggaagaaagcaagtcattaagtaaattcatattagacagttctcttctttatcctaagtgcaaacatatattcagtcaaaaaacaaaatcagaagagctgtattcaaatctaatctgtcacttattggcagtgcaatgaggccatgggaaaaagctcaggctgaggagcagcaggccaggtttctcttccagctctaagtcttgtaagctacttgcccctctcagcctcagtgtctctctctacaatgcagaacaacaacagtgtcacctcattatgctgatgtgcttagcacaagggcaagcaccttatgcatgctcactaaatgatttagttatcttaaccaatctgagtctgtttcctcaccactggaaactaagagttcacatgtcgaaaagcacttttaaaactaaaaaacataatacaaatgtcagagcttaaaaatgtttatttaatcatctgcttggagaatatctttccgaaagtctgctaaaggtataaagatttgtcagatttgtcagaaataaagttctactttttttccccctagaatcactgtttaggagagctgatagtttttatttaaggacaaactcctcctattcacacctctcctctactaacacagtaaaaggttttcttattgactaagagggttaaattcctggtcagttctatgccacaaagagcacaaagtgtactcacctgtacagagttttgtcatgttcactgaattgattctgagaagtgggtttgggaccaatgatgggagcacctgaaggtttagatgctacttctggaggctgtttaaaaaaaaaaaaaaaaaaaagacaaatatgcctaaggaacagataattaacagaatagatatcatgtaatggcggaggggagagccaagaagccttttaaacggtgtgcccatgcatccaaggcactaaagacatatttaccttaaaactgccagtgtcatttacatccttcttggtctctaaggatgcagatcttttgttttcaaacatcttaactctggtgagtacagactgtggcttcattgctggatcttcctcttcttcggtttgagttgggggtggaggcagtggtttggtgtttgaaggcagagcttctggcttatgctgagatgaaggtatcagcggagggacagctgcagcaccatggagaggctcaaaatgacctgctctagaggtaaatccttggggtggtacttgctcgtaactgcgtgaatattgctcaaaatactgcttggactctgcaggcttgggccctgctgaagggtggggctgggcttccggtctgagtctaccatgtgtgtcatacccaggagctggctgctcttcgtgccgcagggcggatgctctaggtgcctgttcgtaacgtggtctgctgtcgtaagacagaggggctggctcttcaaaacgtggaaagtaccctcgttctgaggactcttcgggatgctgtctggagtcaaggtcttgagagtgctgattatcaaaaggtggccgagatgggtagggctgtttgtcatcataatatgaccactgttcttcatacatggggacgcgatcttcgtatcgcagacgatgttcatagtttcgagaaaactggtccgtatagcttgaggactcgtatctgtatgtgggctgctcgaggtctctgctggcttgtttctctacgtatgggagttggggttcataggtcagattaggctctttgtctggcctgtgccctgggtgactaacggctggctgtttcaaaacatggttctgcctcatcatttcctcgggatatggatcctttctatacacctgtataaaaaattcacatttaaggacaaagtcttgtttctaattctagtctattttattagactgtgattaaatattaaactacgatttaatatgtgaaaatggtatgttttaccatttattatcaggatagacaagattagtggaaaaagctggtttaagtgaaagctcaaaatttataatgcaggtaggggcttttatgtttcagcatgtactaaataaacagtgagttaaagataaatattaaatttagtagaaaattaatgcactattgattacacttcattttgacactgaaaaatcctaaagaagatttatgggcatcataatttgtattaacataaatatgtttatgatgggtttcgattacatattaaggaattctggaagatactgaaagccaaaaataaaaataataagcacaaatctcaattaaaaggcctgttttcaaataatcagtataccaatggaagccatgcaaactacgaaactgaaatgatttgtattgatttgaaagcattacagtgtataagcctgcagtaaaaaagcaaaaggaacacttaaagggcaaagcaaaaatgatcatgtgccagattgatggacagcaacaaattagtgcaacaccgcagcacaggtacctttgttggatctacatgcgacgacaatgatggttcttgatctcttagcattatgtgagctgcctcagtacttggtgttcttaaagaatcagcttgtggtgagtaagaggtggaaggagctggggtgggctcctccagtctgacattagttaaatttacattatgattaacagcagaggttgatgatgctgggtttgtttcaggcgaaaggtaagggactggagatgaagcttctgctttctgtgaagtgtttaaaatattttaaatatagtgtttctgtttactgctaactttccacttcaatttatagtgattggtagacatacattttaagtgtgctgaataacaaaattatgacctcatgtcctaaactttttgggaaaaaaaaaaaatccagtacattgctgtgttaagacaaacacacaaaatttagaattaagcccttggtactctcaaattgaaattgaagattaattcttaatctggagaaaggacaacatatatatttttaactcaatcaccacattctaaaatttaataatgcacctctatctacaaaacgttgaatgcttgctgcttacctgttgagaggctggcttaaatccaggggagtctattctatgaattggttgtggctgcgcttgtggtgagtaaggaggatatgtttggttttcatgatgcattccagaggagtcctctcttacaggctcagaggaccgtgtaatggcagactccggtggagtcccaacctcatcattaagagtttcatctagttcttgatcagtgtaggccccgccttctgtgtctgtgtcttcatagtcagaagtgtgtctactgtccgtgctatacattgagtattcactacctggagctgacaggtaggacagacgatcatcatgcaaatcaaggtcatcacttgtagcaccatccgcctgggtcaaataaaagtaaattacaaattttattcagtagttctttaagagatggcctttatcgtacaaggcagattgaaaaggatatctttctctggagaagtcacatctacttcttgaaacttctggtaaggaaaagtcaagaagattgtacaagcacacacgcagacacatggagcaccccttgagatctgaagggcatggatgaaggaaacagtggccggtaagccaggacaaagttagactccagggcccagccctggaagacaacgaagaaactctgacactgctcagatttataaaacctactcactagctcttcagcccttttaagcaaggggaagagggagaatgttaccaaactaagctcacagaaacaaggacacactgacagaatagcacatggaagaatacctatgaaataaacccaacagttcaaaagttgaataagagctaatatatttatgtttaggaaacaactgatatggtttggatttgtgttcccacccaaatctcatgttgaattgtaatccccagtgttgggggaggggcctggtgggaggtgactggatcatgggggtggtttctaatggtttagcaccatctccctcacacagtcttgtgatagaattctcccaagatctgtttttttaagtgtgcagcacctccccaactctcttcctcctgctccagccatataagacatgcttccttccccttccgccacgattgtaagttgcctgaggcctccccagaagcagaagcctgtacagcctgcagaactgtgagccaatgaaaccttttctttataaattacccagtctcaggtggttctttatcacagtgtgagaatggactaatacagtaaattggtaccagagaagtagggcattgccaaaaagatacctgaaaatgtggaagcagctttggaactgggtaatgggcagaggttggaacagtttggagggctcaagagaagacagaaaaatgagggaaagtttggaatttcctagagacctgttgaatggttttgaccaaaatgctaatagtgatatggacaataaagtccaggctgtggaggtctcagacagagatgaagaacttactgggaactggagtaaaggtcattcattcttgctatgctttagcaaagacactggtggcactgtgcccctgctctagtgatctgtggaactttgaacttgagagagatgatttagggtatctggtggaagaaatttctgaatagcaaagcattcaagatgcgacctggctgcttctaacagcatgtgttcatatgtgtgcacaaacagattatctgaaactggaacttatatttaaaagtgaagcagagcataaaagtttggaaaatttgcagcctggctatgcagtaaaaaataaaaacccattttctggggaggaattcaagctggctgcagaaatttgttaagtaacgagggacagaatattaacagacaaaacaatgggggaaaatgtctccagggcattttggaggcctatgcggcagcccctcccatcacaagcctggaggcctaggagggaaaaaatggttttgtgggtgatccaggcccggccctgctgctctgtgcagcctcaggacatggtgccctgcatcatggctgttctagctccagacatggccaaaatgggccaagttacagctcaggctgttgcttcagagggtgcaagccctaagccttggcagcttccacatgatgctaagtctgcgggtgcacagagggagacagttgaggcttgggagcctctgcctagatttcagaggatgtatggaaatgcctggatgtccaggcagaagtctgctgcaggagcggagccctcatggagcacctccagggcagtgtggaggggaaatgtggggttggagccccccaccagacagtccccactggggcactgcctagtggagctgtgagaagaggcccattgtcctccagaccttagagaggtaggtccaccaacagcatgcaccatgcacctggaaaagccacaggcacacaatgccagtccatgaaaggagctgcaggggctgtgccctgcgtggctacaggggcagagctgtccaaggccttggtagctcaccccttgcatcattgtagcctgggtgtgagcagtggagtcaacggagattattttggagctttaagatttaatgactaatctacttacttttggaatttcatggggattggagctcctttgttttggcagacttctccattttgaaaagggagtatttacccaatgtttatgtcccctttgtatcttggaagtaactaacttgtttttgattttacaggctcctagacagaagagactagccttgtctcagatgagactttgaacttctgagttaatgctgaaatgagttaagactttggggcactgttgggaacgcaccatcatattttgcaatgtgagaaggacatgaaatttgggagggaccaggaacagaatgatatggtttggatttgtgtccccacccacatctcatgttgaattataatcctcagtgttggagtggggcctggtaggaggtgatcacgagggcggtttctaatggtttagcaccatccccctaatactattttgtgataagagttctcccaagctctgtctgtttaaaagtgtgtagtactccccccttctctctcttcctcctgctccaaccatgtaagacatgctttttccccttcactgtcttaagtttcctgaggcctccccagaagcaggagcctgtacagcccacagaactgtgagccaattaaatctcttttctttataagttacccggtctcaggtagttctttacagcagttcaagagcagactaaaacaacctgttaaacatttggcccttaaagctgttatgaaacacaatggaaaatcatcacctacatggtggttgctacattaagaagaaattatttattatttttcatagaaacagtatccaacagatggagaggaagaaatacagtaatgcttttcttttgttaagtaattaagaactcagtttctaatagtttatgttgattatcttctgagtagatcagaaagaaagtgagaagtatttgagggaaaggaagctacagagttgcaatcaacaggttatcactggacactaacgtgacactagtacctggatgaaaaagaacactccctgaagaccctgcctagacaccgtgctcagttactcatgagagctgaaggatctggaatccaggaatcagaaagtatttcttccacttcagtatggaatgaaggacaaacatgaaactcttgtcctccagaaagatgcactgctattaactagcaggtttggtgtggctctgcaggtctgctgtgccagaagcatggtcttgggagtcaagttgcctgaatggagctttccacgcagtccccatgcttggctcgttaagactctgaccttgagcactgccttcctgataagaaagactagggtgtgtcaggtctccccatgctccagttttcaagagagcatctgccaggctgggctggggagagtgggaatccagggatctatcctgttagagcacaatccctctgaacaagtctcaatggcttctcaactcggtaacagctgttgcagaagaaaagtcttcttgctatctactctaatctttaacttgccagggttctgaatactataatccagtagccagtcaaggaaatattgaaagtctgggcaagaataacttagaactaatcaatccacttaagtttttaaagctggtttgaaatgcagatgtaagcaagaacgatgggttgctttgaactaggaaatatgttaagaaagcctcaggatgacttttcctggtttagcagggaatatgtaagactgtgtcagatcttgtaaaaaggaactctttctagcaattaggtcaaagtagttggttcaggaaagtcaatgtgaaatgaagtagttttagtttaagaatctattctatgaaatatacttgaagagaagaggacaggaagataagctgtaagttgtaacaaccttttctggcttacaaaatgcatcagtctagcctgataataaataacctatttttcctcacataaaaagctagaaagttggacctttattttaaaaccaagcaaagaaagcacacaagactatcactaaaatactttatagaaaattaagatttgtggattttaaaaaagcctctcagatactacaaatgtatactttgtgcattttgggaaaacatttatagactactttcattttaagaattcactagtgaaagctattaacattggacctgccaaaggatgttaacagaattgtgttgctatagaaggttagtatgaagactacaatcctttcaagtgctgcaaaagtagaaattagtaatagtgtgttcatgtaaagtggtgtggtttgtttccaccttcattttcctatccagttccagctgacatgttattcagagtggtcttaggctctcgtatgcatggtccatcccccagactggttcataatgagaaaaaccatagttctgacacattactataggtgagaacaatagacactgcctctcagtgttaacagctctccttgcagaggctgtgtatgtctgggtagaggacatggggggtcctaagcatgcagcatgcactgtcagagcatctgtagccacagccaggcagaggaaggtagggaccatgcgggggcaaaacacaacaaaaaccaaaccaacaaggaagtacaaagaacaaaataaaaaccagagatactctcaatcttccctaataaccaaaacttactgcactgatctgaaaaaggtaaaagacatttaaaaaaaaaaagcttccctcaatggtgtattctgaggaaatgattaactctccagacaaaataaacagaccttcccatcaaagattgctataaaaccagaaagactgacaatagaaagtagttattttaaagctggccatttggacgtatagaaaaccaaaattcaaagccaggaaggatctattgctttgttcaatatctcccagtatgttgtgagaatgttaacaggtgttgagtgaaaaataaatgcaaggaaatgcatgaagtcggctttttaacttttaagatgtctcagagcctttaaatgccagtgggtacgaggatactcgtgaggggtctagggtttatttcccatccgctgcttgccttcatagtgccttctctcttagagcaagtcctgaattgagcatgctgaggacagcactttgggagatgctcatctaggccatccaaatcccctcattttcagaggaggaaactgaagccaggctcaaagtcatcattcatagccagacaggggcagcatcagaactcaacctgctcttcattataatttaagattctttaggagacaatcctactgcagtggtaattcaacaggtgagaaaatttaagaattctcttaccatcagaaacaactttcataacccctacacacaaattataaaaacctaaaagctaactttccccaaatttctccaatatgttgatctaattagaaagcactggtatctcaaaagcatctctgattagttacataatttactgaacaagtcaaaaaagtaataggaaatgtcttacctttccctcggaaacccataccagctggttttgctgttgttgaattgcttctttcagcgcaccataccaaccatcattcattgaatttaagttaattgtagctgaaaataaattaacgatgtagttttatggttagagcactgccaaaagtcagaattaattcaaccctgcttacagctaaatcgtcattactgaaagatggtatctgaggatgcaaacatttgaaatttctattttgctactgtatattttcttttaaccaaacagcaggtgttaacacaacaggaagctttccaagaaagtatcatgtaagttttagtatttgaacaccgtaacattttggcctacttaatgttgcccagacattgtaagctgaaagaaggcctttattaacatactcacttgtaaaaagatggtgattatttttacgaagtttatgagatcgctcgtataacttcctggcacttttccgagattctggacataacctcattctcattgtttttactccttgcttagaatcagggttaagaaatacaacaattggataccactgggcatagttaagacgatcaactgcatttggtgttacatctaataaagcatgtttgtcctagaaacagaaagaaaaatatatacaaagacacaagacatcattaattaagaatcaccaaattcagctgggtgcagtggctcacgctacgcctataatcctagcactttgggaggtcgaggtgggtgaatcacttgaggccaggagttccagaccagcctggccagtatggagaaactctatctctactaaaaatacaaaaactagccaggcatggtggtgcacgcctgtaatcccagctacttgggtggctgaggcacaagaatcacttgaacctgagaggtagaggctacagtgagccgagatcacgccactgcagtcccacctgggcaacacagcaagaccctacctcaaaaacaaaaacaaatacaaaccaaaacaaaacaaaacaccccatcacattcagaaaaagtcaaaagtctgtactatatttcagtggtaacagatctctttgtattctaatgtctcaggagcacatattaaaaaactaattgtaagttaactcaattccatttctagccaaatttctaaaaacctttctatgaagctcacttttaagacttagccctaacaccgcaatctgacagtattatccacgtacagttagaataaaaatgtttaagaatttaatgttcctgacattccttatgaatgtaaataacaaactacaacttgaattgtactgatataatatataagcagtctgttaattacatctaaaaatcatacacttgttttgtggtaatgaaaaatcatcttctgatgcctacagtaactattctcttgaaagtaatcattataatgcttttcagtaagggcttaattttcttatagtatgtcagtaatagtctcagaaaaactaccttctactttcaaattaaccaaatcccatcccactcaaaaccacaataacataatgaaatgggtcaagttttaataacttacttgatctatgatttgctttattgtatgcaggcgaataatgccagagctacgttggtcagttccagcgtctcgtggttcactctctattcattatgtcaggacaaaaataagacatcaaattttcactggttagacaggagtttctcaactactggccacaactgatatgccggactggatagtactttgtttgtggaaactgtcttatgcatgcagtacttaaagtgagttttaatatgcatacttccctttttttttttcactattttttcaactactttaatattctggaaaaaaacttagccattaaagaagaaaaaatatacaggaatgcacatttttttcttttgcctggggctctaatatggctcaacagggcactacttcccaccctttttcacactgtaacatccagagaaaatattatttgtatggcacactgagataaactgagggggctgctcctttgccaagctctaaccagccactactggcttaagaggtcaataccttggcatgtccatcaaccatcggtaatggtgctatagtggattgcctagggagttctgggttagagaccttagttacatcagtagaaggggaacctgggggcaggaagctgttcatctgtaactgtgagacagcctatggcttcatcctggcaacctgtcttcactggtgtatactgtgccaaatgcagcttgggctggtttccaaccaaccatctcagagcacagcaacgtttgtgactctggtcacaaggaaagtttgaaaggaaaggaagagctttggtgtttcagagatcagacaaaggcagagatctggaaagacaagtcacactgaggttcaagataaatgattttggagaatgagactaccataagacaaagcaccatgggcaagcagggcagaatttcaaatctagtgaacactggagaattaagaagaaagatcaactgggaattttggctggaaaaaaaatgctactaactcctcaactcaaaagactgtcattagactcaaagaagatataaaactaagctacctgaattccctgttgtggagtaaacctgattaaaccaatgtattaccctttaaggcagagctttgtaagtcatcatacttgcttttcccatatctaaaaatcctaagtttggttatgggtaagggttaccaccaacttccttcaggtgaaatgtcatctacagataacttagccaggtgcggtggcaggtgcctgtaatcccagccactaggggaggctgagacaggagaatcgcttgaacccaggaggcggaggttgcagtgagctgagattgcgtcagtgcactccaacctgggcaacacagtaagaccttgtctcaaacaaaagaaaacaaaacaaaacaaaacttcttctgaaaaaactaagaaataaacattttctaacttgctcagattttactcaaatcatttgtctgcaaatcttctgatgttcagaaaataaatatccttattcaacttcattggcaatgaaatgaaaagcaatatattaaaaaaaaaagatgatgttctgattctttaaattaacactatgcagtttaaagatgttactgagggtcggctgggtgcagtggctcacgcctgtaatcccagcactttgggaggccgaggtgggcagatcacgaggtcaggagatcgagaccatcctggctaacacggtgaaaccccgtctctactaaaaaaacaaaaaaattagccgggcgtggtggcgggtgcctgtagtcccagctactcgggaggctgaggcaggagaatggcatgaacccaggaggtgaaacttggagcctggatctgagatcgtgccactgcactccagcctgggcgacagagcgagactctgtttcaaaaaaaaaaaaaaaaggttactgagggtcatatagtgccagtgggaacaaaatccccagcacaactctctggaaagcagaaacttcatcataattatgggaacagctatattcttaaggatttaaatcctttgggaaacaaagcagggcataaacaagcaaacaaaatatggacagatttctgtatcttttgtaatagtaatataaattcgaaacaaacgatataaaaaaagcctaactgaaccaaaaattgcaggataaaatgaaaatatgccattacctatgaaaaagaaaaattggatataaacttttctaaacagtataaataaaactttgccaaaatatgcttaaaagagtggaagaaaatacaatggaataaaatttagggtggtgatatgtgtaaaaattaactttccaacttttccaaacacagaatggcacttttataattacaaaaacagtttaaaaataaaacaaaactgggtacagtggctcacacctgtaatcccagcactttgggaggccaaggccagagatcacttgagcccaggagctcaggttcagcctggacaacctagtgagaccctgtttctacaaaaataataataataataataataataaactagccaggcgtgttggcatgtgcctgtagtcctagctgcttggaaggccgaggtgtgtggactgcttgaacccatgagtttgggactacagtgagcaatgatctaaccactgcactcctgcctgggcaagagtgagactctgtctctgaaaaaaaaaaaagaggagcagtgtgaagaagaggcgagaacgacccccggaccgaccaaagcccgcgtgccgctgcatcccacgtccagcacctacgtcctgtcgccaccgccaccatgcccaagagaaaggctgaaggggatgctaagggagataaagccaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtatttctggtgactgtacagtttgaaatacttttatcaagttttataaaaatgcagaattttgttttacttttttttttttttttttaagctatgttgttcgcacacagaacacttcattgttgtttttgggggaaggggcatatgtcactaatagaatgtctccaaaactggattgatgtggagaaaacacctttcccttccagttttgagagacttcctcttggctcccaggaggagggattccttgactttgacacacatggccaccttggcacaaaagccttgtgctatggaaaaacaaatttgtttttatgtcctcttctccctttccacgtttcagcatagacttaactcccttaagcccagacatctgttgagacctgacccctagtcattggttaccagtgtgtcaggcaatctggactttccagtgatgccactgagatggcacctgtcaaaagagcagtggttccatttctagattgtggatcttcagataaattctgccattttcgtttcacttcctgaaagtcagggttggcttgtgaaaagttgttaaacaacatgctaaatgtgaaatgtcaaccctcactctcaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagtttggcttggaaaaaaaaaaaagaaagtaaataaaacaaggatctgtaagcaaaacgtatttggcatacaaagcactgcagcctcaatacttatacttactatcttattataaatgtctgcaataacaacagctgataatattagcaatgttttattaccctttttaactatttgtgtatttgtcagtttaatgactaaaagagctggaatggagcaagaaagggctgtggtcaaagccgagtcttgtcacttgttcactgagggccaccaggaagtttagactgaagaaactggaaaggatccacgcaatgaccatccaagtctcaggctactcaactgtaacatggatattatactccttacctcagagcatgactgggaggattcaatgacattgtatgttatgcaattttcatatgaagccaagagtttcctaaacggtgacttttctcattaaaagaattggtggaacaaggacatggtcactggggttttctcaccaaattaaaagaatgggataaactgctaatttttcactgacaaaaagtcttatttttattgaatgagtgaatcagaactcactcactttagaggtgtaactcccaacctcatttaagttagccttgaggctacttacttgcaatttgataaatatctggttcttctcttgccagcttttctctggcaacatcagctattggtccaaaaatggttacaggcctcagaaatccagctggagagaaattcacatgaaaaacagcatattttataccttttctttcttaaacatattgacgttaaagggtattaggttagtctgtagaaaataaactaccttctcgaagaaccactctttcataagctggaaactttgtttgaacaggctgagcggacaaatcctctctgctttttcgaagatttctcttggagctgcgaagacctctgaatctccagaagtcagcacggtctccgcctgctgtttttggaagtgtatactgtacactggctagctgctcagctctacacaagaaaggagaaaattaaaataagggcatttaaaatgcaaaatggaaaaagacccacaatgaaatgaaatatacaatactggatggaagttcacatacagtttaaatcttaatggttataataaagaggagtttgtaaacctaagtcagttatagatacgttgaatacaatgaaaaagaattctttacattaccaaaatttcccagtgggattgaaatgatctatcatcatttacttgattcactctatgagaagtatccaagcattcatacctgttcttattagggatgatgcctcgttctacctccttatgatttttaccaattcgaatagcaagccaagagcccagttttccattgtacaaggtatccacaacacggaacacctctcctttgttaaaactaagtccatagggagattccttttcatattcaaaatgggttctaatatagaaagaatctcctacatctgattctacaatgcgacgataaactaaaaggaataaaaacaaacacattatcaatatttagtgggataacaatctgaaagacagtacattatgtaaagatgctatgataatatcaataataatatccaacaaattcttactatgtgccaggtactgtattatttcatgtattcatcactgtaagaattgaaactcttagtacttccattttgcagatgaggaaactgatgcagaaaatacatcaagtaacttgtcaaaagccacatgcttgttttctattatatcatctaacttatctgcaaacattatagacatttccatatctaaatcagcagttctcaaataaaggtaattttatccctcgccatccaacattggacatttgccaatatgcagttttgactgccccatctgtgtactgaaagggtaaggggtgtgtgctagtggcatctcatctagtgagcagaggctaggaatgcccctaaacatccacaatacacaggacagcccctaaaaccacattatttggtccaaaatgtcaacagtgccaaggctgagaaacctggctctaagtgaaaattgtatcacagaaaaaatggagttttctcttgaattaatgctaataaacatctgagtgtattgcttagaaacatcagtacaaaatctgaaagctgctcatatatacttttgtatggttctgatggctaataaatcaacactttctatcacttgtaaagggttggatggcattttatttaaattagaatactataaaggttagtcctattagcatgctctgctaatgagaatcatctgaaattctgtgctcctaaatgacttagaattacataactttctttgagattaacaaattcattcatcactcaactatgagtgacttattttttaaaaatggaataaatccctttgtaagtcctcaaactctacaggtttatctcctccattttctgacagcatctcaccatccttcttcttctgagccaatatggtcacttcttctcctttagggaggtcaagcaggaaaaggacggcttcttctcttatgatatttgtaaaatctacgttgtttacctaataaataagatttcataaatcattcttggctgtttaagaatatgaaaataacatacgcaggacacagatactctcagtctacctaatttgaaaatatcacatctttttttttttttgagacagagtctcgctctgtcgcccaggctggagtgcaatggcacgatctcagctcactgcaacctccacctcccaggttcaagtgattctcctgcctcagcctcccgagtagctgggattgcaggtgcccaccaccacacccagctaatttttttatatttttagtagagatggggtttcaccatgttgggcaggttggtctcaaactcctgacctcaggtgatccgcccgctttggtctcctaaagtgctgggactacaggcatgagtcaccacacccggccgaaaatatcacatcttttaagaccaaaaactttattttactttggagaaaagaatacactctaattttaaaaaaacagaaacaaataaagtgagttaaaggtataaatttatttaaatagtattcagtgtgtcctgacattaaagatctgtgtaaaatttaaccagtttagatgaaaaaaggtaactttttacaagttgctgagaaaaaaaatcaaaagaaaatgggactaaaaagacaatctgcactgtagcaaccctgtaagagcatctgtgtaatgcaggctcagtgtttgccaagttaatatttacttctattagaagcttctaaatgccaaaatgaacttattaaaatgtcaccagtgactgtgtgcaggattacaggcaggttttcttctttccaccttttggaaattttccagattaaaaaagaaaaaaaaaaaccctagaaacaaaaaaacctgacacgcaccacttacttttatgatacaaaacaaaagtgaactattaagaaacattttttagccaggcgcagtgactcatgtctgtaatcccagcactctgggaggccaaagtaggtggactgcttgaacccaggaatttgagaccagtctgggccacgtggtgaaaccctgcctctacaaaaaatacaaaaatttgccacgtgtggtggctaatgcctgtggtcccagctactcaggaggctgaggggaagaatgtttgagcctaggtgtttaaggctgcagtgagccgtgatcacaccactgcattccagcctgggtgacagtgaggcgctgtctcaaggaaaaaaaaaaaaaaaaaagaaagaaacgtttaaaaaaatgtatgccctgattacttcaaaacagggttaagagatgggtaagaaaataggtctctttactttccttggtatagtgaacgttattatacatgttgtatttaaatgtttttgacctaacttgattgacaacaatgtaaacatcatcagaaagaatgaccatatcagatcagatggaaataggtctgaagtcaccatgatgccttgactttttgacatgctaagtttgaagggaaaaggaggaggattcaatgagaaaatgacagagctcaggaaattgctaagtgaaaagactttgattacgagctgctcacttgagcaaccaaacccaagaaagaggcagtgtagcaagagaagcagagagttaccaacattctccaagttttaaaagtatcagtaaagaggcaggaaaagaataaaaaaatgtaccagaatggcagtattatggaatctaaggaaaaaagtacttcaaaaaagattaagacagtcaaaacgctgctaaaaaataaaggaaaatgaggcttgaggatgacattaactcagcaatggcttattgaaaactgagcttcagtgtggtgaaggtggaagccaggctgcaaaactgtatgaccacaatgattgaaaagaaaacaggcaagggcctcaaccacatccttcaacaagttaaacagcaaaaaaggacaaataagacagtggaagatagatgaagaaccagtggagagagaaagacaagaaagtgaacaaagctacaagattctggagcagacaggaggctgaatccaggacactggcaagaggcaggctgagtacagaaagagaccagaatagagaggccacggcaaagactttgtggtagagaagcagaataaatgtaggagctcacaatggacagataccttctgattaaaatgggacatagtttaatctagcaaatcaaatggaggtttggatattttaaaaagaaacaggagacagattaagatggtactatgtcactaggtgaaaccgtttatggggaaggaagggaggactctatagactctactgatactctgcatctaacctgggctttcctgatttgtgtaactaatcctgtctcttgtggagtatgaagtttcaaagccaggcagcttacacatttgcctttgatgtgaattccatctccctgtgtctgagccattatctggggttaaaaaggtcccagaggttgtgtggattgcttcaagatgactcatatgggagaggaacacttgatgttgcttgctgccaagttgtggcccatggcagagtcctgccagtctgaatgtttagttgaacttccaaagactacctggtagatattatcatcgggatataagacttattttcttttatttccatgaacacgagtggtagaaatgaaatgttacattctttactaacacaaaatatagcagtaaacaagagcaagatacaagaatgggaagtgagaagtccagcataaggtagacctgatggattttgactttcaaagtttaactggctcaatggagactgcttacagattacaatctaattacaatagtaagcttgttgtttgatacctttttctggtgatccaaatactttttaacccacataagttgcaatactgacataccctgagaatttgatcaccttcctctaagccttccttggctgcagggctatcttctagaacgccagctacaaatattccaacatcatttccaccagccagccgcaaacccacactatctccttttctgaattttaccaatttcatgctgggcctgttaaaacagatatttcatttgaaacagttaagaagagcttaaaacgttatagcaatcactacagtgaaaactatattcagaattaaataaagaaccatcatttctaaaacttctctcataccactattttactaaataaaatttagtgttagaattcaaatcagacttaataacactattttctgattaacagttttggaatattcaaatttaatatgcaagtactattttacataactaatttataaaattactttgtaaaacaatgttttctcaactctcaaagagttatggtacattccaaatggctaaaaacatcttccattttttccaccccaattcacacatcatttctattaataactgaaaagtcaaattttttaaaataaaggtagaaattgaagtataaattggctaattttcctaacacgatggactcaaaataaggctccaagcattgtgatttctacatgtaacagagagtgatttttaaaaaaactttgcagttggtggagtctttcagtagttcacagagtagttcacttactctgctgcccctctgagttttacaatacaaatcatatagtcattcagcctttctacattagccccatatccattctgtccctttctagttctctgaatggaaaaaaaaaataatgcatacacacccacctctagcatcagtgtagtgttgaaaccttgtgacattccttaaaacaaatactaaaggatgccttctaagaactgactggatagaaacagactgtaattaaaaattacccactatatttcccttctagggattcataagtactctcacattcctagcaagaaaatacactattttacctattctgacaagaagtgtagaaaaaaatccctatactctttattatgtaatactaaccaaattattagaaactaatagataacaataacaacaacaacaacaaaaagtcaaataaatgaatgaaatgtgttgaggaaggagagatttctagtctctttaagccaactaaagagatcgccttaactttcagaacttactatttattcatttctgattgggttacctgacctggaactaacatcagctagtcataaaagtaagagcctgagaaatcagatgaggtctctcactggctggtggcatccttgatccctccatgaaactatttaccagctttactacaaatggtccaagccccttggttgtagtggtatcctagccaggtcaaaagcattctcatagattcctctcctaaacccattgtactgaaacctctttaaatatttcctcaaagtccttaagactccaggtctcagttgggtgtggcagctcaagcctataatgccagcactttgggagactgaggcaggaggactgcttgagcctaggagtttgttcccagccctgatcaacacagcaagaccctgtcactactaaaaaaaaaaaaaaaaaaaaaaaaaaaattagctgggtttcgtggctcgttgcctatagtcctagctactccgaaggctgaggtgggaggattcctcgagcctaggagtttgaggttatggtgagcaatgatcacaccattatactctagcctgggtgacagagtgaggccctgtctctttaaaacaaagcaaaacaaaaacaaaaacaaaagataggactttggaaatcctcttctaaccctgacccatctaatgtgcttcaaaaagcaaaaacaactgagcacagtatccaccctttagtaaaacatggcttctgaaaaccactgttagaagacagctttaggccatatctcaccaacagtgtcatgtgccttagatgactgacattttatactttgtcctgcctgcattatattaactacttgcagtagcaaaacagactcactaacttctgcatcaaatccattcattggctttaaatgaaaaaccaaacctttcctggcacagctactaatcctgtccacgtcctcaaatcttccttggtatttgttctcccagggaaggaggtctctggaatttttcttttttcttttttgagatggagttttgctctgtcacccaggctggagtgcagtggcgcgatctcggctcactgcaagctccacctcctgggttcatgccattctcctgcctcagcctcccgagtagctgggactacaggcgcccgccaccacgcccggctaatttttttgtatttttagtagagacggggtttcgccgtgttcagccaggatggtctcaatctcctgacctggtgatctgcccacctcggactcccaaagtgctgggattacaggcatgagccactgcgcccggccagtctctggaatcttatcattacagtttcctaaacctcaaacacttacacaagttttcaagcaattcccaagaaaggaaaagaaggggactatctatgcctgcacaatttataaaaggttgaattatcaattacctaatattaaaattgtacagttttaaacttgtaaaaaccccatctctttcaggaactacttctatctacctagctgggtctaaatctaacccacttgaggaaatctgccaattttctttttttttttgagacggagtctcgctctgtcacccaggctagagtgcagtggtgtgacctcggctcactgcaagctccgcctcctgggttcacgccattctcctgcctcaacctcccgagtagctgggactataggcgcccagctaattttttgtatttttagtagagatgggttttcaccatgttagccaggatggtcttgatctcctgacctcgtgattcgcccgcctcggcctcccaaagtgctaggtttacaggcataagccactgcgcccggcccggaattctgtcaattttcaattattcacatcatgtcccctttaccagtgccaataaaaaactaatttgggctgggtacagtggctcacatctgtaatcctagcactttgggaggctgaggttggtggactgcttgagcccaggacttttagaccagcctgggcaatgcggcgaaacaaaaccccgtctctactaaaaatacaaaaattagctaggtgtggtggtgtgtgtcctttcatcccagctactcaggaggctgaggtgggaggattgtttgagcccaagaggcagaggttgcagttagccgagattgcaccacggcactccagcctgggcgacagagcaagaccctgtttaaaaaaaaaaactaaccaaacaaacaaaaaactaatttgataatcatgatggtttgaaatttgtttacaaatttacatctcaattctaccaagtatataatgtaaagtaatgaaaggtgttaagatagtaaaaacttacttttgggttgctaactaccctagaacaggttctcaaccaatctcaaccatgattttgcccccaaggaaacatctggcaatgtctagagataattctaattgtcacaactaggggactgctactggcatctagtggccaggattgctgctaaacatgccacaatgcacaggacagcccctcacaacaaatgcttacctggcccaaaatgccactagtgctgagattgagaaacactgatttttttttttttttaatgctccattggaaagctgtggaaattctgatgtctgaatagaatttttttttttttctaattcctaatttaaaagctaggcaggagacagcggtgagaaagaaagcatccaaaaagttcctttgttgtctaatttctaactcactatcatatataagtagcagaatgttaaatataaaaataatcatagtattaggtggtatgtactattttaaaaaatatatgcaatatggtttacaattaaattcctactctgaataatgttaataatgaacaaagaaaacaatacaactttaaaattgtattaccgaagaatcccatcttcatgagttgaattaggtaggacaccatcagatggactgacaggtaaatccacatctggttgcccaacttgggcatacacaggctttggttctaagaaaaaaaaaattgagtaggactcactttagaaaaacatggaataataatgcaagcaaccaagcaatatatgattcataagttcagagaacctgatgaggaacatatctaccatatgtattagagtacattttatagtaataaattctgaagtctttataacaagtaggtatgttacacagtcacctgtgttttccatagttccagcaatcagaatttgaaaaatctattctttaagaacgaataacaaaaaatagatatgagaagagagaattcctacacttcccagttaagactgccaaagtagctacctttcctcattatgataaaatgtttttaaataaccatatttctgccactcagcaagcagagcaagaaagatgatttgagaaaaggaagtgaaagacatcagaaacaaaatctccaggcctcccaggcaaccgatcttagcaccttgctgattctgttttgtcttcacagacagctttaaaaggatgcttgggtcagacacagtggcttgcacctgtaatcccaacacactaggaagctgaggtgggaggactgtttgaggccaggagttggagaccaacctggacaacaaagcaagattccatctctccaaaacaacaacaaaaaacaaagaaaacccacaaaaaaaccccagaaaacccaaaatagccaggtgcggtggtgcacacctgtaatagggaggatcaggtggaaagacagctggagcccaggagttttgaggttacagcgagctaatcacaccactgcactccagctgggtgacagagtgagactctgtctcaaaaaaaaaaacccaaagacaataaataaaggtatactccataaaatgtttatgaaaacactttcaaaaaagcaaaataacttttctttttaaatttttgaagccaatctcatgtttctctttaaggagcagtgttggaaaacaactttactaattgcaagaagttgttaatgataaatattttctatctagaaagtaaaggaaaacattcatgaaaggcaactgatttgtgccaacctgctacccataaggaaaacgctggaagtcatatgcagacaaattcacacatgagaagaataataattgcatctttaaaatcttctgtaaatcctaacaattacttcactctacttgcaaatgtttcttgaacttagtgtttcgttatgcttacctggaagagaaggtgtttgtttctcatttctttcaactgtaacttcttccactgttttaggtgtgtgatcatcagcatgctttacaggagttgagacagccccaggtttagaaattctctcttcatctctactccggagactgtgtgtcattaaaataaaaaatcaagagcataagaatgattctggaaagcatctgtaagagaacagtataagaagaggcaatgcaacttcaaaaacaatgacaacctgctctaacagataccaaaatattgtaaaaacctagtaattaaaaatagagcattaccacagaaaaaccaaatagattcatgtaataaaatcgaaaatgaagaaatatatctataatagcaaaatttatcatgaaagtagcattccaaacaaaactgttggagaaggaacataacatttaataaatggtgtcgggacaactgtccacaaatgtagaaaaattagatccgtatgtttaacaatgacaaaaataaactgatttcagatgaaatcaagtcctaaaaaaagagtttaaacattcacataatcaacaggagtcttctaaagtaagactcaatgaagccacagtatatcaacaaaagtgattacataaaaataaagtacgtgcaaataattgggaaacatatataatactgggctgaactaaatgaaatgggaattctttagttcaaacagctcgatgttaactatttcatacagtttaactaaatacaaatgttgactatgtactgacctaagtaacatatataagaatttggtacttaaaaaaagaaaagacaggcatgatggctcacgtctgtaattccagcactttgggaggccaaggcaagaggactgcttgagcccaggagtttgagaccagctgggcaacatagcaaattccatactctgtaaaaaaaatttaaaatttagccaggcactgtcacttgttcctacagtcctagctatttaagtggctgaggtgggagaattgcttgagccgaggagttggaggctgaagtgagctatgatagagccactacactccagcctaggcaacagaacaagactccgtctctttgaaaaagaaaaaaagaactataaatcaatcaagacaactcaagagagaaatgcaaaaatacaaagaagcttttcagcaaaaaggatgtacaaatacgtaataaatatgcaaacacatttaacctcactaggaactagggaaatacaaattaattagaaactgtattatcggccgggcacagtagctcatgcctgtattcccagcattttgggaggcagaggcaggcggatcacgaggtcaagaaatcaagaccatcctggccagtaaggtgaaaccctgtctctactaaaaatacaaaaattagcccggcgtggtggcatgcgcctatagtcccagctactcgtgaggctgaggcaggagaatcaattgaacccaggaggcagaggttgcagtgagccaagatcgtgccactgcactccagcttggtgacagagcaagactctgtctcaaaaaaaagaaatcatattatcatccatgagaactttcacatgataacatcactggtagggaaagatatggagaaacagacatattcacaaaatgatggtaaaagtgtatgactatttgaaggcaaaatggaaattatcaaaacaaaaaatgtaactaggtcatacactataattccacttctatatttattctagagaaatacaaatgtactcaagaaaacatttataagaacattcattctagtatcagttttagtggcaagaaacaaaataaaactaaatgttcattaataatttccccagataaacagaaatcataaagtgtaccaagacaatatatattttaaaagaagccaataaatatatcttgaataaaaagataaatcaagatctataattttacaaagtatcacgtatatatggttttacagctgcattctcccaacctcggaaaaacaaaataatttgtttaattatcctggaccacagaaaaatataaaaagctctctaattcacttaaaaaaaaactttatttccaaacatatacagccatacagagaacagtatcataaaaccccatgtactcatcgtcgacaattatcaatactctagtcatcagcattccaatctgaggctaccagaacctttaacatccaaatcttgatgacaagagtacaaagagagaaaataatatatttttcattatgaatggaggaaaaaattctaaataaataaaatactagctaggagaatacagtagtgtattagaagactatcatcagggttatttcaagggtgcaagattagttcgacattaggaatttactgacacaattcattattatgcacaaatatttacagaaaaaagtgttaatatcaaactggcatgagaaaatttgcagtcattcctaaacaaaaactgaaataagcaatataattatgaaagaaactattttctaaaaccaagagcaaacatcctatcaaatagtgaaatgctgaatgtatttacactatttacaccaaactcagtaacaggacagtgatacctgtgaacactactgttattcactctgattttgaagacccaggtagtataatcacgagctaatggtcccaaaatattgaaaaaaaaaaaaaaacttaatgaatattaaagactactgaaaaatttcctgaattaagataattttaattacataaaaaaatcttttgtcaatatcgtcaacaatcagatggaaatgaaagggaaaaaataacaccagtaacaagaacattaaacattctaaaactttagactgggggaagcctttgcaagtaggatagaaattcggaagccataaaggcaagataaaaatatctgacaagattaaaaacttttacttgcacaggaaaagatattataaagacttacatttgaaacacagctatatcagtaatctggtactagccattaaaaattttgaacaacacaaacacactctttaaggactttagaaataaaatgcaccagcacagtacatgaaatcaggtacgaaggtgcttactgccatgttttcgcaggcaaatacctagaaacaagatgtccataatacggaaagtttcttatcaaaagaataaactggatgttcaccttgtattgttcaactgaaataatttagctgagtaataattcaaatcctgatctcttaattattaaaagaaaaacccaaaccctatatatgataccaaatgtcagtacgagtctggagaatggcttaattcaagaagagtgagaactgggggtgaactgggggtgaagtggagttggtggatttgatctatttcacttgttctaataagcatgcattgtttgtaaaagactattaaaattaggtgtaatgaaatagaatgatatgtacagacatgaaaactttaaaacggctgggcgcagtggctcacgcctgtaatcccagcactttgggaggctgaggcgggcggatcacaaggtcagaagatcgagaccatcctggctacgggtgaaaccctgtctctactaaaaatacaaaaaaaattggctgggcgtggtggcgggagcctgcagtcccagctactctggaggctgaggcaggagaatggcgtgaacccgggaggcggagcttgcagtgagcccagatggagccactgcactccagcctggacgacagagtgagactccgtctcaaaaaaaaaaaaagaaagaaaataacttcaaaacaaaatgccaaataagacacacagattacagaatacatatagcaggataccatatagctatttaaaaacttttctctaaaatataaacagacatgtttgcacatgcccatgtacagacaagcaacagataccaaataagcaacagtggttcaccttggagggaaaaatagccaaaatagtagccaagaggaattttacagttatctctactatttcaacttttacaaaaatttacttattataataaagattgaaaaaatatatttaaaattatttttaaagactaactttaaacataaaatttggttttattaacgtatattattagtagtctcttttcaggaaaaggtttctttctatgttgtcttcctgaaggaataaaaaataagtactttgcatagtttctatttttgtattcttttaaccattctgtggaggtgtattctacttttaagttggtatattcttaatgagctgcactgaagtagaacaatcttttaggaaaaaaaaaaaagccaagatattttctagctcaaacaaggatgagctacttttaaattggaaaagattggccggttaaatatgcaaatgatgtttaacatgaaacatcactcctgtaatcccagcactttgggaggccgaggtcggtggatcacctgaggtcaggagttcgagatcagcctgaccaacatggtgaaaacccctctctactaaaaaaacaaaaattagttgggtgtggtggcacgcacctgtaatcccagatacttcggaggttgaggcacaagaatcgcttaaacctgggaggcagaggttgcagtgagccgatattgcgccactgcactccagcctgggcaagacagcgagactttgtctcaataaataaataaataaatacaataaattgtaaaagatcaaaatttttagccattacttgtgtaataaaatatcacaattagctaagtataaatcaacaaaattaagctctatccccaaattgtgctgtgctcctcagattaaaagggaagtgcaaaatagtaaattatcctgcattgtttgcattaaaaaatatgattaatatattataaatacaaaattatttttaaaaagagaaaagtgaaaaaataagttaaaatgagtatttttaaagagaatgagttacccacaaaattttaatagttctacagatttctattgctctgtacaaagcagaatttgtttagaaaaggtaagaattccaattaattttcttctttcttgtaactgatcaaaacttctaaaaattaaaatgtgattaacagacattaccatcttggtattttaacttacaatattttaactcaaatgctctcctcaatgataaacgataggtcgtcattggctatacatgtagggctcttgctccatatatcacacaaaacttctgggagtatttttatctttggccaatttgcataccccattgctaattacctttttgtcctgtgatacaatcattataacattaaatgcaattagccttccaaaacaacatttcacataaatgggactcacaccattctattcaatttttcatacaattaatatttgaaatattagcttttgttagtgcatttccattatctaccaaaagatggaggcatttttcaataatacataaagatctagaacagtactgtttaagagaattataaaatgagctgcttacgtaattaaaaattttctagaatccatgttaaataaaataaggcgaaatcaatttataaattttattactcaatgtatctaaagtagtatttcatcatctaagttattaatgaggtattttacattttttgcatactgtgttttcaaaatccaatgtgcatttcacactaacaatacacctcgatttggactggccacatttcaaatgttgaacagtgacatgtggctactggctatggtgttggactatgcagatctagagttacagcacaaaataaaataatcaacttttccaaacattaaaatgttctttcacaagcaaatgtgactatgaagtcaagataaaatctgaatttacacatgaaattagtcaacaatcagtggcaattattgaaagaaattgtgaggttgtgataatgaatcacatttttcccaaaccttcctaattcttttttttttttttttttttttttttttgagtcagggtctcaatgttgccctggctggagtgcagtggcacaatcatacttcactgcagcctcaacctcccaggctcaagcaatcctcccacctcagcctgcaagagtagctggactacagatgcgtgccaccataccctgctaactttttctacttgttgtagagatggggtttcgctatgttgcccaggcgagtctcgaacttctgggttcaagttatcctcctacttcggcttccaaaagtgctggattacaggtgcaagccaccatgcccagcccttcctcacataattctatcctaatggctctccatatttaagcttaaaaatgtgtgtgtgtgtgtgtgtgtgtgtgtgtgtgcgcgtgtgtgcgcgcgcgcgtttgctattatgaggaaagctttctataaaaattatgtgttcggagtcaggttcatgtttacgtattccagctcctggtagcctagaaggaaactttgggcattttaaggtacctcaagatcctcttatgggcacttttgcttttccccagaagggtaagacgagtttctgttgtttttttttttttgtattaacttgcacgtattaatctaaaggtaatgaccttgttatctggaggctatgagctagttgaaagctctagacaagacagctgacaaagatggactggaaaggagtctctgagagagattttataggtcacatgaacggactcactgttaagcagagcctactttaggtcttacccaatcaaatgtgtgaccagtgtagccgattaatacacactcaattagattagcaaggagtaacatgctgtttcaagtaaaaaactttggttgtgaaattgcagctgtttggagccatttagtagaggcagagggcatgcagcatggtcagtacagggtcctggggagacgctgtaggagagaaggtgcatcccctcagcatgctcctgcagtgcccagcatcctaaagtactcggtggccagcagcctgctccagagactctctcaaacggttctgttgtgtgaagtctcccatgagatacctccccagcacatgggagtacaaataccatgcaagttcgtctggtgacataccacagcaaattctcggccactcagtgagcaccgttgttccctttccaagaaggccagatctcagccctgaggatgagtgagtgggagcctcttcctttggcactctatctcagcaccaaggagagtagctgctccttctatctgtggttcttttgtgctttgtttttgagacggagtcacgctctgtcacccaggctggagtgcagtgacgcaatctcggctcactgcaacctccgcctcctgggttcaagttattctcctgtctcagcctcctgagtagctgggattacaggagcatgccactgtgtccggctaatttttttttttttttgagactgagtctcggtctgtcacccaggctggaagtgcagtggtgcgatcctggctcactgcaagctccgcctcccgggttcacgccattctcctgcctcagtctcccgagcagctggactacaggcacgtgccaccacgcccagctaattttttgtatttttagtagagacagggtttcaccgtgttagccaggatggtcttgatctgccctcatgatcagcccgcctcagcctcccaaagtgctgggattacaggcgtgagccaccacgcccggcctaattttttgtattttagtagagacagggtttcaccgtgttgcccaggctggtcttgaactcctgagttcaggcaatctgctcgcctcggcctcccaaagtgctgagattacaggtgtgagccactgcgcccagccctatccgtggttcttaatcttcagagctctctttagttcttaccagtcaatccctcattactcctgttatgtttaatttctttacattcaactttctctgttcatggaaactgtgctttctgtctcctgattgataagatatgcctggtcgccatttcatagccctttccctcttacttctagctctatgaacacctttccaatcaacttgatgtgccttattttaaaaataaccttaatacaggaaataaatgaagcgctgaacattcactctagtagaatatccttttataaagccaactccccattacaaattaaagacttatactacaaaaacggatttatacatacttttcacaagttcattaattgcataaggtaggcaagaacaccacagtttaggttgaaaacaaaagctagctactaatccctttaaaaggcattggattatctcaaccacaattaacaataaaaatatgctaagaatttaagttaactgtattccaaagttttttccactgacaggaaaatttcagcctggaaggctctattgcaaaaagacagaaaagtgaaggcacactccagtttcatacttagaatgttgcaatcactgctaatcctctgattttatatggaaacaaatatatacacattgaagttcccccttcacaacgattaaaaaatggtctctctctgcactggtacccaaagaattctggggatgagaaagcaagagatacagggctggtacttgggaacaaaaggtaaaaaagttgcccaggaagtatgctgagaaggcaagaaaataattaccttaattccactttgtcattttgtaagctaatttctcacaatgtaaatctgtcctttacatgtaatctgctttctaaaacatacatgtgttcatgagcatgcttctgaaaaaatctgagtctatttcactgtgatattgtttttaggcaataatttagatgtatgtgtttgtggagcttattcttctgtacaagtgcttctcatcttaaacattcatctattaatctagtccatccgcattagaagaaaaacaggtctgtggttcaaaagtaattttcatggatatggacaacttttagtaagaaacaactgaggaaagcccaagaggacttttgtctcacttaaagaattgtgttgttacaccttcattggtggtataatgattattctgtactttgactaatacttatgactaacatagcactttgtgcagtttatttggtagattttatagtgggagaccaatgtcacaaatcttattaggattctctcagagaaaacagaaaattgtctcacatttaaaaaatctgcaaataagtttttttgtatatttactattttagacaagtggagcagtttgtttttaaatttgccatttttaaatattgtacttgtagaagaaaacaaatctcagctgatggagtaaataaactttatacttttactttttatttttgtactacttatttttgagacagggccttgttctattgcccaggctacagttcagtggcgtgatcatggcacactgcagcctcaacctcttgggctcaagcaggcgatccttccacctcagcctcctgagtacccaggatcacagatgtgcaccaccacgcccggctaaatacacttttttttttttttccccccagacggagtctcgctctgtcacccaggctggagtgcagtggcatgatctcggctcactgcaacctctgcctcccaggttcaagcgattctcctgcctcagccttccgagtagctgggattataggcacacgccaccacgcctagctaattttggtatttttagtagagactgggtttcaccatgttggccaggctggtcttgaactcctgacctcaagtgatcttgcccaccttggcctcccaaagtgctgagattacaggtgtaagccatcgtgcctggcctactttcactttttaaacgggatatatgataaatattgaagcctgcctttctgctatttgatccatgatctcctcttaagggttaaaatctaacagcaatcactgaataccccatgactatacttgggtttccattaactagagaaacttaatcaactaaaatcttccctcttttggcccctcacaaaagcacactgaaaataaaacctcacattggaatttcaatgaagtaacctgaaatcccctcaaactgaaaataacagttcgttcacaaaagttcaggatgtcatcgatattccactcactttgaaatgttagataaaacatattagcaaaaaagcatttaataacatttcaagtaataaacaacattaaaaaaactttcatgttctaaccaaattttttaaaacagaaaaaattcacttcttggatctccaaatcactttctcccttgctcttatgatgtagccacatgggctatattgctgcccttccagtaggtcgagtttccatctcaggagcagtacacgctttgccttattccagaatgaccttcacctgccagggtctttcttacccagttcaaaatgatgtgacctcagagaagctttcttccctgagcctgttatttaatattgtcccctcctgcttcactattacactaccctgattctctttatagcatttaaccactaacgaaaatttactttttgtattttcaaatttatgtatttgctttggatatagagcttacatccaaatgatagcagggatcttgcctaagattgctcaggatatggccaggcgcagtggctcacgcctgtaatcccagcactttgggaggctgaggcaggcagatcacgaggtcaggagatcgagaccatcctggctaacacagtgaaaccccgtctctactaaaaaacacaaaaaattagccaggcgtggtggcgggtgcctgtagtcccagctactcaggaggctgaggcaggagaatagcgtgaacctgggaggcggagctcgcagtgagccgagatcgtgccactgcactccagcctgggagacagagcaagactctgtgtcaaaaaaaaaaaaaaaaaaaaaaaaaagattgctcaggatatttatcgccatacactgataacatatatgtgacattagtaagtatttggcaaaggacgaatgagcaggataacatccacattactggtaaaatctttcaaccttcactacagaaggaacattcactgtggtgccgcctgttgatcactcagaactatgcacattggtcacggtgtaaggtacaggagccatgggaaagaagtcactgattcgactcgctgattaaccattgaaatacttaatgaatcatatctttctaactggcaccctttctatctttctcagatgaaagggaaacagaaaaaaaaaaaaaaaacaaaggtaaaggacctcatggtgagcctaaaaaagaacacgtagtactaccaacaccatgttcactaccaacaatatatgtaattcttgtttagaataaagcacttatcaaattggagttatgaaatttatttagacaaaagactaacaccaatgatcagtaaataaaatctgaaactcaccaatcagggtatatacccaaggaatataaatcattctaccataaagacatatgcaaacaaatgttcactgcagcactattcacaatagcaaagacatggagtcaacctatatgcccaccaatgacagagtggataaagaaaatgtggtacatatacaccatggaatactatgcagccataaaaaagaacatgtcttttgccagaacatgagtggagctggaggccattacccttagcaaacgaatgcaggaacagaaaaccaaacactgcatgttctcacttgtaagtgggagctaaatggtaagaacttacgaacacaaagaaaacaacaggcactggggtctacttgaggggggagggtaggaggagggagaacaagagaaaactattggatactgggtttaacatctgggtgatgaaatagtacgtacaaaacacgatgacacatgtttacctacgtaacaaacctgcatatgtacccctaaacctaaaagtcaaaaaaattaaaaagaaattcactagtcagaagatcgttacctctccacatttgaaatagaaaaaaaaatgctcatcaatattaggatgtttcaacaataatttttagcctattggcaaagttgcacaggttaagcatcccttgcctaaaatgcttgggaccagaactgttttggatttcggattttggaatatgtgcatcatactggttacccattgagcagccctaatctgaaaatgcaaagtctgaaatgcatttcccttgagcgtcatgttggcactcaagttttggattttggagcattttggattttgcactttcagattacctacgctcaacctgtatgtaagtttcagagaaaattaagcaatatgtgacagaaactatatacagtaagatgaaataatatttatagttctcaaatgctgacgaaaacaattatggaaggtagaggaaaaggtgtgtaaataaaaaactagatctttaatttaaaagctaagaccacataaggatattttaatcaacaatggaccccacagacaatagtggtccctgaagattaaaatactgtagttgtactgtcctttcctacgtttaagatacacaaatgctaactgctgtttcaactgcctacagtatttggtacagtaacctgctgtacaggtttgtagcctaggagcaataggctacaccatatagcctgggtgtgtggcaggctctaccacctaggtttgtgtaagtacactctatgatgttcacacaaggatgcatttctcagaaggtatccccatcaagtgacacgtgactgcacattatatgctctacctgcatgtttatttggacttactcagcactcttggaaaactcctaatatggagtggattgtatagataagaggttttgatcccaaatatatgatcttaacttggccaaacgtgaatttaggctaaaaatttctgattcagaaaattcaattttactgtcatgtatttgctgtatcataagctgtatcaatgctgacacaccttttactttagaattcagtagaggcatttctcaggaggaacaatgaatgaagagattaaataactgttacaaagtttcaatcttctgaaaacactgcttttaagtttctcagaactaaccattttcgtaaaatggatttgctaaatataaactggactgtttttctatttgtgaaaacacattccccaaacactttagaaaacagtttaggccttagatgaactctgttggtttcagggaatgagtgtaacaaatgtaaatgggtagaatgccaaatgtaaatcttgacaatccaaatttcccacatttcaatttcatcctgttagtctgaacttttactgtaatagaattttttcaatattgtacctgcttatgactaatcatgctcacttttataaaaatttatagaataaaaaaggtaaacacctgttgttccctctaacatacaatgttagagggaaacataaaatgggtctgttaaaatagctgtaaatatgaggaagaatacaatctaaccaagcagaggcctagatcataccctgcaaatcaaatactctctacttatgcagggactacaggaagatcagtgaaatctcttttcaatgatacccactcagtaatcaccaagaagcaaagtgtcaccatcaactgtgggctctctcagtattcccagctcctacagcccaagtcttggcccagactgggctctgcaacaatactaagtgaaatacaaaacaaagcaaacaagcccagcaacaagcatcaagttataagaaaaccactgtaattattttccctatgtatatgtattttttgaatttaaaaacaaaactattttaacattccagacaaagcatttggaaactttttctgtaattgactcccttggccatatagtctctcttataacttcttgattatgccattgtggaatgggtttccaataaaactttacaaaaggaggaggctggatttagcccacacagtgcagtctgccaactccagttctagacaacagtgaggatactttgttcatctaattataatgaagaacaagcttgtgtgtttttctcagaattctctccatatgtttgctctctaagaaaagaatatcacacagaggaacataagtaggtcatgacaacaatggaacgctggtagattttagtttcctgaagattaagtagtaattaagctatgaaatttctttctctacaccagtaaggtcaaagatttgggtcaaagagccaacagttttaatcctggccccaatcccaggtcaacaacataaccctggactttattgcaacctctcaattttagtttgcttaactatatagaatgaggaaatctcagaaaatggttaaatacaagcagataagaaagcacatttggaaattctaacttatgatactattattactactatgaatcaccataataattacagtagcgaacacatgtgccaggtattgtaataactaatttctcaccattctgtaacgtatgacctgcctgcttcactgcatatggggatgctgaaacacagaggtttcaaggttatgcaagtaaccaaaggcaggctgggacatgaacccaggaagtccggctccaaagccctaagaattcactatattctatcacttctcacaaaatgaagatgaagaggttattattctcagcagataatcgcacatcctaaaaatatacaaaagtattcagaaatctaggaagagaacagggcagggctgatgtttgccaagacagacttccttttacactcaagtgaaacctttctcacagagaccaggtcatttttttatcacttctttaaagataatttacatacaatttgtaaaacaaaaagacacttatacagccaaaattaaataaaaaaaacaaaagactatatatggaagtcctttagtgtttttttacactagcattttactcttataatgtatctaagttgtttctcaaaatgcagggaatgctctaaattaaaactccacagttacaggatttgaagattcaactttggggtggaaatgaaacctttaagcaactggtactatttatatcttgtctgtaggcagattactaaattttcaggaattaaattctcaccacaaaaaatatgaaaagaacctgaagagatttttccttctgtagttgaagttaccttttcttttatacactatactttctaaccattagttcccacatctagcagtgcacataagagaaagatgccaggagcttaaaaacaaaaaaatacagttgacccttgaagagcatgagatttaactgtgtgggtccacttacactcgaattttcttccacctctgccacccatgatacagaaagaccaacctctcctattcctcagacgactaaatgtgaaaacaaggatgaaggaaatgagcagtgaaggaaaacgaggatgaagacctttatgatgatccactttcacctaatgaacagtaaatgtattttctcttatgattttcttattaacactttcttttctttagcttactttaagaatactgaatataatacatctaacctacaaactttgtactgtttatgttatcagtaagcttccactcaacagtaggctattaatagttaagtttttgggaagttaaaaatcacaggtggatttttgactgtgtgtcgggggtgagagggaggttttggtcccccctaaaccccaggttgttcgagggtcaaatgtattgcctgcttccgtctcagatcagctgaaagcaagccccagaagtttgtatttttaaaagctcccatattactggtgctacccatgaaaatacttaagatacctaggagaaaaaaaaatcacaatataacacaaaaatagtaattttaggggggaaaaaccctccacttttaagttaaggttacagattctaagtgctgaggaactctaaatgaagaaagtggacatcaaaaagaattttctaagattgaaaattttttacaatctaaactaatggcccaacatttgagattttgattcagattgcgttatttaaaaggggaaatcatgtccaaattacttaagcatggtttctagctgagaaatagatgttaaaattacagctgctcccgtgaatcatcaaaggtgctatatcactgtgtgtgtgtatgtgttgcggcagtaatccttttcctgataacaatctatgctgtgccaggaagatttttagaatatattaactgcagcaattaaaaatcatcatcagttataagataagccaactttacacgtaacatgccataatattcctttaaaaaatcattacatccttaaaataaacaccagggttctcataatttataaatctaggtttgaaatttagaaataatcagcttcacaaatacataaaaactacagtagatacgaattagcaaccacattcatagctcttacaagttatcctcttctcttactagttcccattttagtagaatgcgaaacactttacagttttaactaccactgtcactgcggttttttacaaactttaaaaaagctctctcctggctaggtacgcctcccttttcttacttctccctcgcctcttcaccttcctaaaagaacgtgctccctgttatccagttctctgccttctttccaaactgtttctcttagcaattttagtgacttctatggcttcagctaacacctctatgcaagttaagtctcaattcaacatctctaatcctaaatcatctcttcagatctagacccaaatttactttttctttccagctttactgaggtccaattgacaaataaacattgtatctattaaaggtgtacaacagtgatgttttgatatacatattcaaatgatgaccgagaccaagttaattaacatatccatacctcatagttacttttcttagtgtgtgtcaaaagaatgccttaagatctactctcttagcaaatttcaagtatacgttattaactcttgtcactacactgtaaattaggtctccagaacttactcatcttataattgaaactgtgtaccctttaacaaacatctccccattcctccccacccctaacccctggtaaccaccattctactgtctgtttctatgagttcaacttgcttaggttccacagtaagtgaggtcatgcagtgtttgtctttctgtgtctggtttatttcacttagcacaatgccctccaggttcatccatgttgttccaaatggcaggatttccttctttttaaaggctaaatcacatttcattgtgtgtgtgaacattttctttatccattcatgtgttcgacattcaggttgactccataccttggctattgtgaataatgctgcaacaaacatgagagtgcagatatctcttcgagacagtgatttcatttcctttggatatgtacccagaagtggaattgctggatcatgtgctagttcgttctggttttaattttttgaggaacctccatactgttttccagaatggccgtatcaattacattctcatcaacaacgtataagggttcccttttcttctaaactgtctcttcagccctggactcatgtttcaagtgatcttcatgtggactgcagttaaccatgggtcaggtggtggcctatagagccttgggagtctccagaaattgtatgcaattgctgcgtgtatgtgcacatgcacatttttctggagagaaggatcataattttcttcagattctcaaatgtacgtgtgactctaaagaaagataaactcaggtaggtcatatactaccagtataccagaacctttggcataaatactagtgttttgttttgtttttgagaaagagttccgctctgtcaccaaggctggagtgcagtggtgcgatctcggctcactgcaacctccgcttcccaggttcaagcaattctcatgtctcagcctcccgagtagctgggattacaagcatgtgccaacactacctggctaatttttgtatttttagtagagacagagtttcaccatgtcggccaggctggtcttgatctcctggcctcaagtgatccgcctgcctcggcctcccaaagtgctgggattacaggtgtgagccaccgcgcccggccaacactagtgtatttttaaaagagaaaacaaagtccaggttaatgtgtttattaaaggacttctgtagttaactttcccaagcagtagatttctgaagcttgctagcatcttctaatgcaatagtatgacaaactgcagctgcggatcaaccgcttttgtaaataaagttttatgggaacatagtcatgcccattcatttacacattgtctatggttgcttttgcagttgagcagtgaaaagaactatatggcctgcatgattgaaatatgtttactatctggccctttaagggaaagtttgcggttattttagatttaaaaaatgtctaagttgagaaaaacagatctaatcttgaataatcaaaagaaatacatcttttaattttatttgtaagcaatttcagatactggtatcaagcaaacaaaacccctgtattttttaaaaaaatagggtgtcttacctgccattgcttggctgctgcggcgagtgcctggaatgatcagaaggctctgaccgctggtcaggagatcgtgaccggctgcggcggggaggcctatcgtgtgatcgaccagaatgatctgatgccagtgactgaatttctgaaatgtctgttaataaaagggtgctacttattttcccacaaaaataattacagtcaagtataaggtactccagtaataatgaagataagctagtaagtaaaattatatataaaatggaagatttatgcattaatttcacctgccagcaatcatatcaatagtggtgagttgtctacaggaaaaaatgtatataaaacttatagattttgaaggtgtttggctggtagaaaattatcatttcattcaaagatgttcaatctccctagtattttaagaaaataggtcacttagagggaacgttcaaacagaatcacactcaccgtctctctcagaggcattagcagagtggatgctgtcagaaagatcagggacattcaatagcgtagcccgttcatctctttgaactaccatttttaatttgcctttagacctttctatcaatgtctttgcatctgtcaatgacatattttctgtcacagtaccatttatctgcaacagaaaataaattacagcttgaaagtaaataataaaatacaaatgttaacttagtttgttataaacagaaatatccaaaccactccttgctatgaaaaccaaaatattctctctacacttttccaaactgtcaaagtattccaccttcttgagatgataaaatctttactgtactgttgctgtcagaaaaacccatagtagcatcccctaactccttctttgaggctgtcactttctattacttataaacaaacgaataaataagcatttcaatagtatctggaagcaattatcagaactttttaatgtgtaagaacagacatatctatctacaaagtagtaccggcctgtgaataattatctcaggatgaccctgtgatacctaaagcattggtgtcgacatgtaataatgcataaagggaatttatatccctctcccccaaacactgatttttaattctctttggcaaaactgcttcaaacaagagcacagactacatggtaactctagaacttgttttctatttcagttcattaaaaagtaagaatatgattataccttcaatacaacatcaccttcttgaatattgccatctcttgctgccaaactatcttgtgaaatttccttaacaaatatatggcttgccaatcgaagaccatattctgaaataatgtaagtaagtgtttttagtataacatcctaagacacctaaatagattttacaagtatacaactaaactaattaactactgcatagagttttcaagtacaatcaataacaagaaatatttcttggccatcctgcaaataagacattccctctaattagcaagtctgcaatgtctccgtgaaagccaagggaaagtgtatggttcaaacgaaggactgatagaccgtgttcccatattactgaaaaggagaaaatccccaagaggacaccatttctttttgaccaagcattgatacactagctcttcagaatgattaaggaatacaattttctttaagagacagggtctcactatgttgcccaggctggacttgaattcctggggccaaaaaaccctcctgcctcaggctccagagtagctgggactaacagacatgtgtcacactatgcctggctagagatataattctaaagagtaaactgcttgaggtttgaaaaactttgaaaagattgaccattttattgatgactattatcatgcatatactacttctatttttcccagctcctagaccaaaaatatttctgatcctatacaccccatgacactggatagacatactcagagtactagcatgtactaagcatgagtgcaaaggcttacaaccagccaggcagatgtgggcaggagttataatgccaatcctttcctttaaacaaccaacaaagtatccaagagtgagaacatcactccgtctgtgggtaaggaatgttggaagttgaggaaattactagcagagtccagagaactgcccaggttcctgcaacagctgcagaaaaacatattttaagaaaaataagaacaatgactacaactatcaatataatgtcaatagtaaaaggattgcccctggttctgtgaggagagtcttactgcattaaaaacaaaatcaaaaaccaagatggaaaacagaaaactgttttaacatgggataaattaacagacctattacctaagtgtttaaaaattacataagagtaggctgggcatggtggctcatgcctgtaattccagcactttgggaggccaaggcgggcggaccacaaggtcaggagttcgagaccagcctggctagcatggtaaaaccgtctctattaaaaatacaaaaaattagctgggcatggtggtgcacacctataatcccagctacttgggaggctgagggaggagaactgcttgaacctgggaggcagaggttgcagtgaactgagattgtgccactgcactccaagcctgagagagagagtgagactccgtctcaaaaaaaaaaaaaaaaattacatcagaattacagtttaacttaagacaaatatacaaagagtactcacagccagaaatagaatcagggtgaagaaaacggccttttaggatatctgggcaaggaatgaggcagtcatccatatggtcattacatcacagaaggatagggtattggttaaaagactgttcttcaagattaaacacttataaatgaccattacacagatgaccccaaaatatttcttgtatattagtttgttcgttcattctaaatatttcttggggtatatatgaactaggtaccaggcattagggagaaagcagcaaatgagatagttcctgcactctggcaatttgcagtcagtgaaaaaaaggatgttagcatggtaatcccaaatgcggtgagttcagagggcagaaacacaagggttcttcacttactagggggaaggagaaggccgccctgaggaagatatactaaagttaaaactttacctaagaaagacctaaacctgaagggtatgtttgtgggggaggggatgcatggggtgagtgacggctgaaaagttcaaaacaaatgcatcaaagtaatgaagaaaaaaacctggtggacctaatgaagtcataagtctagtgtagctgagactgagaactaataaagaaaggggcaaaagagtaagacagaagtgtcacagaggatctatgaagaaatctgcagaatcaacttaaagggatccaagagacaacctatgagaccaaatgagtctatgtaagagatgacagtggcttggaaaagggtggaggcagtggagaaagagtgggatggataagagtggtattcaggagtgaggacattcatcatgcatgggaaaaaaagagaaggcaagggtaactaccatgtcatctgggaatggcctgagaaactggatcaatagaaacacattcaactgaatacttcatgagaaatacaaagaaaaattttaagagggagatgagtttcatttgagatgtgctgtgtttcagggacctacaggaacatctaagtgaatatgcctaacagttggaacacaagagtgtaaagatttgggctggagaaagaggttctgccatcatcagcagtgactggaagcaggggagcagatgagattgcctaaattaattgttattcaacctgaggaaaagaaaaaaaaagttaccttaagtggaaaaaaagattctaggagagaaactgacagaacgttataaagggcagggtgaggagaatgagcttgcaaaagatacagaaaggtgggggaaaaaaacagaaagatacagtactaccaaagaagacattatttttgaaaataaggagtggttaaccatgtgaaatgatactgaaaaggcaagcaagctagagactgaaaaacttccactagatttagtgtgaacatttttgggggcagagcggaaaagataccagaccagagaggattgaggggtaagtagtgaagtaaaaacagcaaatgttgacaacttcactgagacttcactgaatgggggtatggaataccacctaggagatatgccaagtggtaaagcagatcaaagtaagtcttgataatattccaactgtaacaccctttatatcaaaatgatcagtcatgcatgcccacagaaggagcaagccacagtcagatccattttttatcaaatttaatgaggcatgagggaaagcagctgagtttcagtttcaaaaacttcaaagaagtactgcattatggagaaatgctctataaggggttcctttccttaaattcctccatttaaaaaaaacagtctggagtgagggggaagaagtcccagcagggcacagtggcttcccgcctataatcccagcactgtgggaggccgaggcaggtgaattgcctgagcttaccaatttgagaacagcttgggcaacacggcaaaaaccctgtctctacccaaaataaaaaaattagctggacatggtggcatgtacttgtacttccagctaccagggaggctgaagtgggaggactgcttgagcctgggaagcagaggttgcagggagctgagattgtgccactgcactccagcctgggtgacagagccagaccttgtaacaacaacaaaaacaacaacaacaacaacactcccaagatttctctccatgattacactactaacagttaagaaaaacactgaatttccatttggtgatggtgtgacatttcttgttagcataatttgtacctggctattctcatcacaacaaatccaaaagccaagccctggacaattcacttgaagtgttatctgttccaacggaaaaaatgaacagtccctgaagcctgccataacaggatttgacttacagtgatagaacacaaacacaaagacaacaaagcaaagacatgaagagacagcaactgtacttctcattaaaattagttttaaattttcatgtgaaaaaaacagcaagagttggcagagaataccttcatttttccgggatttcaccagtgtgactttagtaggtttagcaggctggctggaagccactgaccgcctgtctgaccgcggggacaagctcctctctctacttgcacttctatccctcggccaaatcttctcactccttctgttaaccacaccactccggccacttcttggatcatgtatttcctcatcataactatcttcttcattatcagatactggttcaggatcaggacgacttactggtatttgaactttcttcttccttctaattgtctgcaagttaaaaaggttaaaaaataagttgactgattttcatatatgtacgttcagttccaaagagaaaggaatattacacttctcatcccatattaactatgaaccagcaagaaacaatacacaaacaactacaacaaatttctaaggaatacatttccataaaggctgtgttttctgttctcctgataaacagatctggttaagcacaaataagaacgagtgggcctaaaaacctctttatttacttcacacagaaagatcttcctggtgtaataatcacaagcttacagggaaactaacaactgttggtggtttgaataaaaaggacagcactgtactctaatgccatcaaatatactctaggtgctaccaaaaccacagcaaacttccatgcccaacttgcttccttaaaaattttagaatgcatcaatatcaaagcccacaattgccccagacctctaagagataatttattctatagccgcactaacattcaataatatgttggagctaattaactcagccgtacttcaccaacacaaactgctttcagtctctggatctcttcaatttgtactcccagtctaggtgcaaattcttccctctggcgttcttttctcaatgattctggtaactggctctgtattgcctgtccacttatttccttcattctctgcaagctgacgatctacatgtattacacctgctgactgaatggccctgtaatctgtggactacactttgccttctcacaatagtatacacttgacctcactgtagttctacaggatctccttgtgtatcactccttgtcttctatgtcggacaccttgagctactgaaacttttcactatcttatttccaattccttcatcttagttcatcagttccatcctggtttcactcgcattccccctaagtttgcatgagacatcctgttgccatatttaaatgactttttcttgacccctcaatcatctgccctgacaaactccagtcctattattaccttcacttccacactttgctgatgaggccctctgtaaattcattttacagaagtcttgctcttgttcagcaatcctttcatctacatattgttgcctctctgtggaattcgctaatgtaggtattctacaaccattcttcaagatcccagccactcagcctgctttaagatcagtgccattttactccccctcccctcctaaattttttcagtatttcccctcctaaattttttcagtgtctcatttatttggtcctctttccttctggtctcaaagaccaaggcaatcttctccctggatgaacaaaacccttgtatttgagctctcattctcatccctacctacctctaagacttttttcttcatcaattaccatactccaggttacctgaaacttcaatctctttatttacctaaaatctgtcctctacctactaagctcccccaattaatcttctatttctctgtcttgctattcacctgcatgttatcatcttttctctcttctctatgtgcctaaacttcttcaaagggctgctctacacttaatactactgcttcctatgactactactattattatcagatactggttcaggatcaggatgagggcctgagcagagggccattctgaggaaacaacgctgaagctcaaggatgagaaacagcagaggccagcatgtgaaaaggaggacagccaatgccctgttatgaactgaaagagaaaggctgcccttctcctattggagcaacccacagctgaagtccttatagggtaatattttctgtaaagcattcctaatgctagctgcctgcttttacatctcacttctatttaatttccaacatattatattggaagcaatacctggtattagtattttaatcttcagttcctccctagtaataaacaaaaacaaagttgagcagatgagcactcaaggctttccctatcattcctgtaagagtgcgccacctctttgggatcctactgtacctgacctatcaacctgagatgacgtgcattatatggttatcagtatgtatacctatccagcccactaagatttgagttttttgagaagttccttaccatgcatttaactgtacatataatgcaatgcttgcatctagtaggtgcttaacttattgaaaggtaaccagtcctattgtgattctctacttatgaatcaacagttataaacatgaataataattagtaggtgtgacaactatgctcgattttaacactatgaaaaatttggaatcaaaatatttaggaaaaaaaatgcctacttcaaaatagtttagcttaactaagtctcaaaggtaaaataaaacaaaatgatgccatgtaagtactagaaaaaaatacaacagagaggcttttgcaattaaaaggcttttggaagcatgacaccaaggcagaaccaataaaatgaaagtctgacagacatgacaaaataaaaatgaaaacatttcaatgttgtaataaaatgatacaaaacaacaaacacaaacaacttacaagcattcacaaaagcaaagaggataacaacacatgaggtatgtatgacaaaaggctaataatctgactacagaaaacactctagtatgaccatcaccaccatataaatgcaaaggacatgaacaggtaaatgaaaaaacaaatgggtagtaaatacaccatgagaggatcaaatccacttgtgatttaaaatgtttcatttgaaacacttgtttagtttatcagtttggcaaagatttaagacctgttgaaaactgaactctcaatagcctattgattttctgaaggacaaactggcaatacatacatcaaaagtcattcaggccctttgactctgaaaagtcactcctagaaaattattctaaacattaactaaacaagtaggtagtaatatgatgatttttgcagctgaattttaaaaaaatacttgcggactggacactgaaatgcctgtgaatgagtgggttggataaatatatatgcatagtgaaatgctgcatggccatgtggatacctacacagtcatgcaccatgtaaaacaacggacagcacgtactgcaggggccccataatatcacaatggagctgaaaatctcctatcacctagggacgccacagggtcataatgtcgtgggtgcactgcagtacttatgttggtggtgatgctggtgtaaacaaagctactatgctgccagtggaatagaagtgtagcagatacaatatgtacagaatataatacttgataatgactatgttactggtttatgtatttactatgctaaactttttatcattactgcagagtgtactccctctacttatttttttttctacatgttaactgagaaaacagcctcaggtaggtccttcaggaggtgttccacaagaaggcattattgtcacaggagatgatggctccatgcgtgttactgcccctgaagacctcccactaggacaaactgtggaggtggaagacagtgacactgatgaccctgatcctgggtagccctaggctaatgtgtgtgcttgtgtcttagtttttactaaaaaagtttaaaaagtgaaaaataaaaaattttaggctaggtgcagtgcctcctacctgtaatcccagaactttgggaggcggaggcaggcagatcacttgaggcccggagttcaataccagcctggctaacatggcaaaaccccatctctactaaaaatacaaaatacgggcttggtagcggtcgcctgtaatcccaaggctgaagcacgagaatcacctggaccagggaggcggaggttgcggtgagccaagatcacgctactgcactctagcctgggtgacagagcgaaaccgtgtcttaaaaaaacacagcctgtaatccaagcactttgggaggccgaggcggggcggatcacgagacagcctccatcaggagatcgacaccatcctggctaacatggtgaaaccctgtctccactaaaaatacaaaaaaattagctctggtggcgggtgcctgtagtcccagctactcgggacgctgagcttgcagtgagccaagatcgcgccactgcactccagcctgggtgacagagtgagactctgtctcaaaaaaaaaaaagaaaaaaaccaaaaagaacccaaaaaattttaaatatttttgtacagctgtacaacgtgtttgttattacgagagtcaaaaagttagaaagtttataggttaaaaaagtttcagtaagctaaggtttattattgaagaaagaagacttaaataaattttataaatttataaaatattaaatacattaaaaatattaaaacgttaaaaatttagtgcagcctaaatgtacagtgtttacaaagtctacagtagtgtacagtaatgtcctaagatgtcacattcactcaccactcactcgctgactcactcagagcaacttccagtcctgcaagctccattcatagtaagtgcactaaacaggcatataatttttttatccactatatatttttactgtactttttccatgtttagacatacacatacttaccattgttttacagctgcctacagtatccagaacagtaacataatatatctattatgagaagtgaattatcaggcaattctgtctttgtgtgaacatcacagaacgttatcttcccaaacccagatggtatagcctactacacatctaggctacttggcatagcctattgctcctcggttacaagcctgtacagcatgttagtgaactgaatactgtaagcgactgtaacacaatggtaactatgtgtgtatctaaacacggtaaaggtaaatacagtactataatcttatggaaccactgtcagatatgtggtctgttgttgaccaaaacattgtcatgtagcatgtgactgtagaggaggaaaagaggaggaaacattaagccaaaaagaggtaactatttggccgggcgtggtggctcatgcttgtaatcccagcactttgggaggccgaggcaggcagatcacgaggtcaggagatcgagaccatcctggctaacacggtgaaaccctgtctctactaaaaatacaaataattagccgggcgtggtgtcaagcgcctgtagtcccagctactcaggaggctgaggcaggagaatggtgtgaacctaggaggcggagtttgcagtgagccgagaccgtaccactgcactccagcttgggcgacagagcgagactccgtctcaaaaaaaaaaaaaaaaggtaactatttaactgtcccctttcctttttcaattgaaaaaaatcctggtatctaaactgagaaaatacacgtaccagtgacataccacaccagtgttagaagaaacactcaagtgtaaacaaataactttggaactattgtttcagttttccttaaatgggaaggataaattcaaataccagaaatgtatcaacaataaagttggggtacctttactaaattacagagaaaagatacttacaatttttgcatttttcccacttttccttagttgctgaacagcaaaagcatgttcaacattatccattgaaactccgttaaccattgcaactcggtcattttccctaaggggaaaagggcacaaaataatatgttagagaaaaacattctggtaagtttatgatgatatttccaagataggtacttctaaaatgtaatctaattatgagccaattaattaatttctcttcagatcaatgataaaataatgtcaactgacttactttcagatttctctgcagaatgtttaacaagtaactaaccacaggtccttaatttttttaagtcattaacaaagtatttccccaaaagactgaacagatatcacatacacgaaatgattcttggtagtacagttacagggcattaaatgatactaagtcatacagctggaaaacttactcccttttaagtttttcatcttttaattctcttttaattcttctaattatagtgccactattttgctagtgtattttgtgtttctctttatcttactaatcttcatagggaataaaaagggtggcaagacttggggaggaggcttctgaaggctagattctacccaaaaggagttatacattttctttttcactatttttacagttacacattctatttaaagtgagtgatactagctttccaattttcatagggataaagcttcctttattttctttggagacagggtctcgctctgtcacttgggctggagtacagtggtgcaatcatggctcattgcagcctcagattcttaagttcaagggattctcctgcctcagcctcccaagtagctgggactgcaggcacaagccaccatgcccagctgatttttaaacttcttttgtagagatggggatctcactgcattgcccaggctggtctcaaactcctggtctcaagtgatccccctgcctcagcctcccaaagtgctaggattacaggagtgagccaccacacctagccagtttccctcttaatatatgttaatttaaggaaaaatatatgaagcatggcacaggtggagtgtgaatatgacaaaatcactaagacagtgtaagacagtacgccagtgcctgaggagaggaacactgcttgttgcacagtgcccacgataagcagcactcttactgtagctgtccttcagctggtcctcctttcagcacatctgaaatcactattgacgtttccccactctgaaaatgaggattatctcgtccaccagatattgcaattccaaatccaaatccaggagcctaaagtaaaaattacagtaaaatattgctattaaggacaaaaataattgttatatcatactctacaatctagagaagccaaaatataaaaattacaatcttaatatatctgtgatccataaacactcacctgcatggttacctattagaattatccttgtacaagaatgcatgctctaataactactggacataacagaatattaaaaatcgccaactatatacatgttctttaaaaaccaaaagacaattaaaaattattaacactgagatcctgactttatttttgatcagaagaggtcctgaggagactggcagagcccagtgtgatcatcagccatcctggcaactgatttagaagatgacagacttatccagcatacacaccctttgtcattttacataaatatcaattgctttgaaaatcaagtattagttatttcaacttctttcaacaacttctgccaactcctaaaaatctctgtagaatataatgccttgtgcacactatacaatagaaggtgtacattagccatattgaactaacattgtaaaattacctttttaaaaaactaaattataataagctacacacttctgaaagagccaagaatctttaccacaatgactcaggacaggccggtatagaaaaaattcaaaatattttccaggttgttaaaaaattacctaatctcaaagaaatcactattccctagaaaggatatgaagtacttaagagtagtttaaagagacaatatacattttcttaaggctacagaatcattaagccagaaatgtatgtttttgtataaaactgtacaattcaaactgcctgaggacaaaggtaacaacttcctccctcagctttccagtccgcaacagaggagactattttcaccatgaatagtgcatacatcacctttcctcccatcccaaagcctatagaagtagcaaaagaaaaaaaaaaatcttcttaaaaatgaataaataccaactattccaagtgtccatcaactgatgaatggataaaacgtgatatatatccatacaatgaaacattgtgtgtaaaaaggaatgaagtactcatacatagtataacatgaatcaaccttgaaaacatcatgctaaggtgaagaaaccagtcacaaaggttaatagattctattattccgtttatataaaatgctcagaaaggcaaatctataaagacaaaaacctgaatggtggttgtctagggctacagggattggagggggtgataattcaatgggaggtgttttttttttccccagtaatgaaaatgttttaaaatggactctggtgatggtcacacaactcggaacacgctaaaaaccaatgaactgcatactttaattgtttggcatgtgaattatatggcaataaagcgaacacaaaaaagttaatatgaaaaaagaaaataataaaacagggaaatttctgagtaactgaagataatggcaaccatctgaatctgtttctctatatattctcccaaaatttaatagaacaaaaatagaccaactacagtggttctcccttatcctcggtttcatgttctttgctttcagttacttcaggtcaactgcagtgtgaaaattttaaacggaaaacttcagaaataaacaattggtaagacttaaattgcacaccgttatgagcagtgtgatgaaatattttgccatcctgctacgtcccatctaagatgtgaatcatccctttgtccagtgtctccacgccataggggctccccacccattagttactcagtagctgtcagttatgagatcaactgtggagaggtaacacaatgcttgtgttcaagtcacccttattttacttaatcatgaccccaaagtacagtagtagtgatgctggcaattcggtataccaaagaaaatctgtagtgtttccttcaagagagaaggcgaaagtcctccatttaatacagaaaaaaaaaaaaaaatatgctgaggttactaagatctacagggagaaggaatcttctattagtgaaattgtgaaggaaaacaaaatttgtgctggttttgctgtcacacctaaaattgcaagggtttcgccacagtgcatggtaagtgcttatttaagatggaaaaggcattaaacttgtgagtggaagacaggcacagaaatgtgctccaattaacagcaaaactgggtttgatactatccaagaattcaggcatccactgggggaacatacaccccatggctcagaggggactactgtacacaaaaccatacactcatcataattcaaagacaatatccaaatttcaaattaaaagcaggactaaaacttcaaaaataaacaattagagacaaatgactattagaacagcattagaaaacataagacactacagaacaaattcaaataaatttgaaaacctaaaggaaacataattcctgaggaaatatagatggccaaaattgaccctattataaataaaaggcttaaacggcccaatttctggagaaaaaagcagcaaaatttatgagggaattatcccacaaaaaggcaccaggcgcaaatgatttcccagagaaattgtgccaaaacatgcaatatccagacagcctcagtacaatatattgtttcagaacactgatatcaaggaaagcttctaaattctttttatgaagcaagtataatactgacactgaaagctgatgactgtccatgataatgactaaccccccaatattacagctcaacataatttatttgtatcagtgcaaaatacaaaataaaaataagcaaacaaaggccaacactacataaatactccatgaaaaagggattaattccaggaatgcaggattagtaggaaatccactggcataatatatcctattaataaatctagagaaaaaaattatatgattatctccaagatcctgaaaaagcctttgacaaaatttgactttcaccgctgaagagaaaacaaagtttgtgaaaaggcactgtaacaaaccctgtaagtatgttgctttttgttaaagtacacaaagaaaatccagcttttcatacacagatacagtcattgaaaaagaagagttattttagtagcctttttaggtaattacgaaaattcatgtttgactttatgccaaaaacttaataaatgatagtttcctaaaggagagtaacaatgtacagtttgaaaccatatcattcaactgtctgtactgttgcatgaattatctattggcctattttacactctgaatgagtattttatccatgtataattttactatagcatgccttagtctttcggaaaatactggttccctgagttaggtaaatcttccaaatgatgccacatttcaccacacagtgtattttaaaatcatgtgttaatatcactatcaaggttatcaaaagagtctttaagtactgaaaagctactgagcttatggtggcagataaaaatttctcaaattttaaattttgttttaaaaatcagttttcattgttagcaacaaatactatcaagaattgttctccttgaagcaaggtactcattcattttggagaaatatgtttgtcaaatattcaagtttggataaccatacattccttcaagtaaacaattgttcaagtaaaagtgatgcctgccttccaccccccccactcaatacacggctgcaattcaaataatcacacaagtactttagtacaaggcagaagtactttaggcacacttcctgtttgcatacctagactactgaaaacgtgtgtattcaagggttggaaagtaacaagacacagttcttactgtttcaagtcattcttaaataaaactgaaattgttcttttaatctacgagtgtgtgacaatgactattatacggtttggtgcccctgccttgatttgggctacaaagcccacagttttaaccgccattgtttctgaaccttcagtcaaataattacacagcgaagaagataagaaataccttcatattgaataaaaagagttttgcccttgaacctaaaaaggtttcagggacctttaggagtccacagaccatactttgaaaatgtcgatattaagaactacttaaacatgaagggagaaaaataaataaataaataaaacaatgaaacaatttacaaaagatatatgagatgttaaaacccacagataaatgcaaattaaaaccaaagaacaccaagaacagaaacattaaagtataacatatttcagaaaagggaggctatagcaaacagtctactactgatgggcacacaaattgctacaactttcaggagaggaatttggcagtaacctaacaaaactacaaatgtactattcttttgacagagcaaactaacttctagaaagtaccctaaagatacacatacctctctcacaatacaaaagtaacaaacgcacaaggttattcattgcagactgtttgtaattgcaaaatgctgggaaaacacctaaacaccccagccttagtaaacgattatcctttccctttttttctccttcaaagaagttggggctaatctttgtaatttagtaatttgaaaaattactctatgtaattttacagtatgaacttacatcttgtttggtagttattttattttcctcttttatttaaaagttaaaaacataaaaagattaaaaaaaaccaaaaacattaggaactttcaataagcaaggcagggatgcgagcatacatttaaaaaaattacttgtgagcaagtaaatgcagttccggcacctagtagggcaggtaatcctgctacatcagtgcttaccacagttcacttaatgactatccaggagccctgcgacttcttacccaggctgcaggtaagaatcacttgggaacaatttcaaaactgcttgctgatgcatgatcctcaatctataccaattaagtaaaaatggagaagaggagttggtggacttaaaaaaaaaaaaatagcccccaggtgattctaatgagcagccaggaacgagagctgcagctttcaatgttttctgaatataagatcagttcattaaaaatttcaaaaggttcaacttttccccactttcccttccctctaccttcataattgtcttatttggccctttcaacagatttctcacctccactgcactacaagtgttggcagtgctgtccctctaacacaaagaccctaatccaatagatccttgccccaagtccaaattccttagcatgcagtgcctttgaatacaactccaaacttgcttcccagcaccccagtctttgctctaaacccacctaaatactgattcctgcttagggagatcatgcaatatcaaactatggcttaacatctcctctctccctaggatttccttactaccttatcaatcttgcaagcttcagctcatctttcaaaacccaggttccatgtcacctcattcataaaactacccttggctttcacagaagtggtccatcctgtacatgtgctggggcacatgtacacacttgtgctacttaacacacagcacaagtagcctcggttagcaaggccctatttgggaggaagtcacatatttaaaatcgaaggctaacctgattaagcccgccaaacttaacctgtctttttcatcgcttacttctagttgatctattttaaactccccactagcaagtcacatagcaaatctcccacgaacttccttacagataacttccgaatgtgggtcactacagtaacggttgcttaaagttatttccaggaaccagttggcagctcttgtccacttcaagctgattaagaccaccgaaccttcaactgggcctgcatgaatgcccaaagagaggtgactgtttgatgtcagagggccaaaacctccttcctcagatcatggtgatactgccatttttcaaacatgcattctatgaagagctgtgtaacttgactacatgtatgcagatcctaactaactcacttttccttacccccaatctttctcccccacaccttggagaaccttggtactctattccaaaaacatccttaaaatcccatctttggagaggtgggtttgagatttgttctcccatctcctcatttggcagtcttgtgagtaaaatcttttctctttgccaaaacaagtcatcgcagtgactggcttgctagttcaatatattcgtatacatctttcaactcaatgcaaccctgcagaagcctgacacaaagtggttcacgaagttagtgaacctcaacaagtatttgattgattattcaatttaactttaattctatttccctttatagagactctttttttaaactagccctaattagagcactaaaaacagaattctggaaaaattagcagcaatgagagtaggcatgaatgaatcttcctgaataaaaacaggcagtcgactacataacaaaccaagaatccaagtgcaacatttacaacaaaactagggggtcaatgtatcccccttgaagtgcaaaatgcaacgaggaggggataaacaaccagctatggagacttccttagcatgtgaacgaagccatattctaaaacaaacaaacaaacaaacaaacaaaatcctccccgccacctcccgaaggaaaaaaaaaaaaaccaccacaaattacaggcaaaaatgagaaaaaacgatcagaatcaaaccctctataccagcagtcctcaacctctttggcaccagggattggtttctttgaagacaatttttccacagaccggcaggtggaggggatggtttcgggacaatccaagtacattacatttattgtgtactttatttctattatgattacactgtaatatatgatgaaataatcacaaaactcaccatattgtagaatcagtgggagccctgagctagttttcctgcaactagatggtcccatctgggggtgatgggagacagtgacagatcatcaggcattagattctcataaggagtgtgcaacctagatcccttgcatgcatggctcacaacagggttcacactcctgtgagaatgtgatgccgccacaggaggcagcgctcaggcagtaatgagagcaatggggggtggctgcacatacaggtgaagctttgctcacttgcccgccactcacctcctgctgtgtggctcagttcctaacaggccaaagatccgtacatctctgtggcctgggggatggagacctccgctctacataaagttactatataatggatactgagtagcagaataacatctctgcagacaataaaagtatgcctgaaagaaggcttaaaagagggagaggattaaaactgttattagcacaagaagatacaagacatgaaagaattagaaaaaatgtagaaatgaagaggaagaattcgagaccaaatctgaaattttaaaaggtcattttagataggaatataagaccaaaaaacatcttaagagaaaaagtaaaaaagaaatcaacctaacatcctaacattaaatcaacaatacatacgacattaacaacattacatacattaacaacctaacatcacaacaaaaagaactataggaacaagagcaaaccaactccagagctagcagaagacaaaaaataacaaaaagagctgaactgaaggagccaggcacgaaacaccattcaaaagaccaacgaattcaggaattgtatttttgaaaaaaaatcagtaagataaactattagctagacaaagaagagagaagatccaaataaacacaattaggacaaaggggataccactgaccccacaggaatacaagtaaccatcagagaatactatgaacacagccatgcacacaaactagaaaatctagaagaaactgataaattcctggacaaacccaccctcccaagactgaaccaggagaaactgaatctctgaacataccagtaacaaacgccgaaagtgaatcagtagtaaatagcctaccaactaaaaaaaaccccaggaccaaatgaattaatagctgctctacatgtacaaacaagagctggaacaatttctactgaaactattcccaaaaactgaagaggaggaacaataccccaactcattctatgaggtcagcatcatcctgagaccaaaacctggcaaagacacaaaaaacaaaacttcaggcaaattatctttgatacacattgatgcaaaaatcctcaacaaaatactagcaagctgaatccagcagcatattaaaaagctaatccaccacaatcaagtaggctttatccctgggatgcaaggttggttcaacatatgcaaatcattaaatgtgattcattacataaacagaactaaagacaaaaaccacgtgattatcttaatagatgcagaaatggctttcaataaacttcaactcccttcatcttaagaactctcaataaactaggcattgaaattgaaggaacacacctcaaaatagtaagagctgtatatgacaaacctacagccaacatcatactgaatgggcaaaagctggaagcattctccttgagaaccagcacaagacaaggatgccctctctcatcactcctattcaacacagtactggaagtcctggccagagcaattaggtaagagaaagaaataaagggcatccgaataggaagagagaaagttaaactaccctgtttgcagatgacatgattctgtatctagaaaacctcatggtctcagtgcaaaagctccttaagctgataaaataacttcagcagagtttcaggatacaaaatcaatatacaaaaaccactagcattcttataaaccaacaacagccaagagccaaatcaggaatgcaattcatatggaaccaaaaaagagctcaaaaagccaagacaatcctaagcaaaaagaacaaagctggaggcattaggttacccagcttcaaactaaactacagggctacagtaaccaaacagcatggtactgtaacaaagacagacacacagaccaacggaacgtaacagggagcccagaaataaggccacacatacgaccatctgatcttcgacaaagctgacaaaaacaagcaatggggaaaggattccttattcaataaatggtgctgggataactggctagccatatgcagaagattgaaactggaacccttccttataccatacatagaaatcaactcaaaatggatgaaagacatcaatgtaaaacccaaaactataaaaaccctggaagacaactcaggcaataccattctggacataggaactggcaaagattgcatgacaaagatgccaaaagcaactgcaacaaaagcaaaaattgacaaatggaatctaattaaactaaagagcttctgcacagcaaaagaaaccatcaaaagagtaaacagacaacctacagaatatgagaaaacatctgcaaactatgcatctgacaaaggtctaatatccatcatctatacacaattttacaagaaaaaaaacaacccccattagaaagtgggcaaaggacaagaacagacacttttcaaaaaaaaaaaaaaaaaaacacgttgccaataatcatatgaaaaaatgctcaacatcagtaatcatcagagaaatgcaaactgaaaccacaatgagcggccgggcgtggtggctcactcctgtaataccagcactttgggaggctgaggctggtggattacctgaggtcagaagttcgaggccagcctgactaacatggggaagccccatctctactaaaagtacaaaaattagccaggcgtggtggtgcatgcctgtaatcccagctattcaggaggctgaggcaggagaatcgtttgaacccgggaggcagaggttgcagtgagccaagattgtgccactgcactccagcctgggcaaaaagagcaaaactccatctcaaagaaacaaacaaaaacacaaagatatcatctcacacctgtcagaatggctaatattaaaaaaagtcaaaaaaaaataacagatgctggcaaggctacagggaaaagggactgcttatacacgttggggaaggcagtatggcagttcctcagagctaaaaagaaaactaccattcgagccagcaatcccattactgggtatatacccaaaggaatataaatcattctatcataaagacacatgcacgtatatgttcactgcagcactattcgcaatagctaaaatgtggaatcaacctaaatgcccatcaacgaaagactagatgaagtaaatgtagtataactatgcagccataaaaaagaataagatcatgtcctttgcaagaacacgggtggaatgggaggccatcatccttagcaaactaacacaggaacagaaaaccaaacactgcatgttctcacttataagcgggagctaaattatgagaacacatggacacagaggcaacacactggggactaccggagggtggagggtaggaggtgggagaggagcagagaaagtaactattcggtactaggcttagtactaggtgacaaaataatctgtacaacaaacccctgtgacacaagtttacctacataacaaatctacacatgtaccctgaacctaaaatgaaagtttttaaataaacaaataacatttttaaaaaaaagaacgccagagattttataaaaaggatttgaggaacattacaaacactaaagacaagcaaaagcagcatgatatatatgaacagtaggagtccctaaagaagcaaatcaaaagaagggaagagaaaaattagtttaaaaaacaaaaaaaacttcgctgatactatttttgaaaaaattgaaactaggtactgaaagagtttacatcactgtaaatatgtgagttatctgagaatatcaactcaggaggactaataccaaaaatatatttaaatgactaaattttaagaaaaaagaaatagcaactcaaggattttttttttcttttgagacagagtttcgctcttctcctccaggctggaatgcaatggcttgatctcggctcactgcaacctctgcctcccgggttcaagtgattctcctgcctcagcctcccaagtagctgggattacaggtgcccaccaccaagcctggctaatttttttttgtatttttagtagagatggggtttcgccgtgttggccaggcttgtctcgaactcctgacctcaggtgatccatccccggcttccaaagtgttgggattacaggcatgagtcaccgtacccagccgagtcaaggattttatattcaacacaactgaccttcaagtacaaaaaacacaaataaaccagtcaacatgcaagaacacaggaaatattgtctttatgatctcatcctaaggaatctaataatattctgacaatcaaaatgacgagatacatggataggactggtgataagcatcacatatatactgtacttatttataacaccaagattaaacgaggattaaagggttaaatgatgtaacagctatatgatctagatatggtaaaaaccattttaaaacagagaaataaatgatagcatgtgcaaaaaaaaatttttactgtttccagtaatcaaagttgacagaggtagattactctgaggcaataatatgctctctgtattagacttactaagagactatcatggtaccttcccaaggggttttcaaaagaaatggaaaatgtgccatttttttctcatctatcttcaacgtaaaaattgtatagttctgccaagacagttgatttttaaaagtatgtttacatgagaaaatgtacaggataacttttagcttctggggatggaagaaagagcatcaaagacttgccgtatttcaaacttttgaaaccttaagcaaccatgagcagcaataacttctgtgtttatatgtctacgcctggctagacaactgaatttatgttagaacttggaaacagggtcctggaattttttcagttatgtgtcctgttttactggacactagccatgcccattcctttacatataattatgactgcttttgcactgaacagttccaacagggaccttgtggtgcacaaagtcaagctatttacaatctggcctttcacacaaaaggtctgcccacccactggttaaagtatttcttggttccttaaaaaaaaattcctgaaagttgctcctgtttcagaaataactgcttaatttattctccaaagattcctctctgttcctattgaatatgcccaattacctacttaaggattccacttgttgccttttattttattcttccatttttccatattaggcttgtacaatccgctaattataactttcctcactaattctagtcttacttttctcctcttattcttcctattaacctttcaatggaatttcaatgaacattcaatggaacctgttctagccatttgttttcacagtggccactgagatcacagaatttgaaaaccagatggagcctcagcaattgtctgttccagctcccttcttacagctgaagtcagcaggcctgggtcctgtgtgtctctatactacttgccaatcatgaccttatggaagacctccacagatttgagttccctcatctgaataagagagattttaatgttatcaactttaatatactttgattccatggggatcccaagagatttaaaggccttttcaaaattagttagtggtaagcccaaacagattagaagtcacaagatccaagcactgcagattttctaccaacttggtagttctcaaaatgctgttcaatcttctatgactgtcagattgattcggttttttaacagttatgtcccttggctagtcaaattgtgtgtgtcttcctgtttattcttactctcattcttttagttctgatacccaaatcatagttttcatttctcattcctgttccattttcttatttccagcttcttacagaatacctccaagtccccttctttaagactgtcattttctctataaaattagcctcaccaccaatgttctaaacaaacattggctcctctattgccaaattacctaccctttattttatttactttattgcatgtatagagagacctttgtttagtttatgtgaattacatgagttcttaatttcagaaattatgttccataaactttttgttttttagagacagggtctcactctgttgcccagaatggagtgcagtggtgcaatcacagctgactgtaacctcaaactcctgggttcaagtgatcctatcgcctcagcctcctgaagtaactgggactacaggtggacacgaccatgcctggctaaattttttgggggtgtgtagagatagggtctcactatgttgcctccactggtcttgaactcctggcctagagtgatgctcctgccttggcctcccaaagtactggaattacaggtgtgagccactgtgccagccacatttaaaaactgtaaattaaacgtgacatataaatggaaagagcactgtatgctgagtccaaacctgggttcaagttctcgctcttaaggggcattttactagacctttctgagacttaccttacttcacatggttaacacctacttcacagacaaatataatgaagggtctgaaaaacttataatgtactaagtacaaacaatagccttctaccagataaagggagtgtatcttagattacatgtttgcttcagcttaaatactttatcagacagcagtttggagctgcttgaccgataaaattccttttatcactttactgatatataattcatatatcataaattcactctttaaagtgtatgattcaatggtttttagtatgtacacagttgtaaccatcactggttacagatggtgccaggacagctggttaaccacatgcaaaataatgaatttggacccctacctcacaacatctacaaaaattaagtttaaagaaccataggtctaagtataagagcttaaactctaaacctctttgaagaaaacacaggaataaatcttcatgacctgagttaggcaacagcttactgaatatgatgtcaaaagtataagcaacaaaagagaaaacacatacattggaccccatcaaaattttataacattttcaccaccctaaaaagaaactccgcattctttagccatcatctctcaatcccctagcctcatcaaccactaatataactctctattcacctattctgaatacttcttataaatggaatcacataatatatgttcttttatgactggcatctttcagttagcataatgttttcaaggttcatcaatgttgtggcatgtatcagtacttcatttctttttattgctaaataatattccattctatgtatatatcatgtttattcattattcatcagctaatatagccagatctattatgaataatggtgccattaacactcatgtgtaacttattatgtagacatttgctttcatttctcttgggtgtatacctatgagaggaattgctatgtcccataataattctatgaggaattctcaaactgttttctacagcagctgcaccattttacagtcctatcagcaatgtacaaaggttttaatttctccacatccttgccaacctttattgtctttctgagtacagccatcctagtgggtgtgaaggggtatttcactatactttttgatatacatttccttgaaggctaatgatactgaacatcttttcatgcatttattgcacattcatacatcttctttgaggaagtatctattcaaatcatttgctatttttcaactgatttgtctttttattgttcagttataaaagttctttatatattctagaaacaaatcccttatcagatgtatgatttgcaagtatcttttcccattctgtggaatatcttctcactttcttgatggtgtcctttgaagcacaaaagtttctaattttgatggggtccaatgtatctgttttcccttttgttgcttatacttttgacatcatatccaataaaccattgcctaacccaggtcacgaataattatccctgtgttttcttcaaagaggtttagagtttaagctcttatacttacacctatggttcatttaaacttaatttttgtaaatcttgtgaggtaggggtccaaattcattattttgcatgtggttaaccagctgtcctgggtctgttaatgactgttcttccctccagtgcattgccttggcaccccatcccaagtttacctcttatgcaatcacctccctagtttaaacactcactggctcacccttaaaattacctgactagtttccttgctttctatactcatcttttaatactttagtatacaaatatttaatcttttacataattctattttagaaaatgaaaaagcagagtaacgacgagcaactcattcctgaggaattcacttcatttcccaaagaattagaaaaatgtatgcattttctaagggcgagtatctgaaaactaaaaaggtgtgggtgtgttacagcagcaggagaggtgaacacatgtggttaccatctgaagctacacacctacactaatacgataagcatcagacttgtgactattaagcacttcaaaaatggctagtgttacctgaaaggtgctgacattgaaaagtgaacaattttgtaagatcaactcatcaatttttaaacttatcacatgttgaaatatattttgtgcatactaaataagacctattataaagttagtttcacctgtttttctttttttttacagtttttaataagaagactaaaaaatttaaatttacatatgtggtttatattatactgctactgggcggtgctgttgtagacctcccaagagtgactttattcgacatggttagtgtcctagggaattaagttttttggggcagaactaggtaccaagcactaaggagatagaaaacggacttaagatttccaacccttgtgaaagttataatgtagtaggagatggggtaaacaactatctgatgtacatattcaactgtcactgaggaccagtagagagatcagaatccatgaggaggcaaattctgcctgtttttttctgatataattccagggcccacaagagtacaacagtgcttggcatacagtagaacactaaaaaattacttagtctttaagaatgaatagggtttcaatggtttctagaaatataagatgaagaaaatatcttctggaaatacaaatgaaagaatgaagcatatattattctagacagtaaatagcagaaaatgttaggttctcatcaattaaatggcttttttataacattacctccaactttcataaaattgactgtcagatgtcaaagaatatggatttgtctttatttggcaatacagagtatctatactccaggttattgccaaaagaatacagtttcaaattatccccttcacttactaccactgccaaaagcccacttgctcacctcagagagaacaagctttctgattcctctgtgtttcttaaaagtgggatgccagaggccatagccctccatttcaaactgaagcctatttaaaatacgtgttagggatcccagcccagacaaactgagtaagaatctctgatgggcagggactgtgcagttgatccctctttacaataaaacctggagagccactgctctaatcagcagtcagcacactatggcccacagttggaatacagccacattcgtttgcctgttgtctatggttgcttctacaatacggctgcagggttgagtagttttgacagagatttatggtctgcaaagcctaaaatacttatttactatctggctctttatataaatactttgctgatcctgctctagatagtctaaattttattcggcatcatcttagaacaccaaacaactaagacagttgaaagtaccattctgtagcctcagagaatgaagtcaattaagttatgctttggcataactcagctcccactggcaagactttttcattgtccaaagattttaaaaatgtttttatttttaattattatagtaaacagtagttgtatatatttatgggatccacatcatacattttgatacaagtataatgtgtaacgattaaatcagggtaactgggatattcataacctcaagtatttatcatttctttgctgttacgaacatttcaattccactcttctagttactgtgaaatacacaataaattaacgatagttgccctattgtgctactaaacactgtatcttactccttctaaccatatttttgcacccattaaccaagtcttccatccctacttccctaccacccttcccggtctctggtaaccatcattctactctctgtctccgtgagttcatttttctttttttttttttttttagttcccacgagtgagaaaatgtggtattcgtctttctgtgcctggcttatttcatttaacgtaatgtcctccagtctcatttatgttgttgcaaatgacaggatttcattattttttatggttgactaatattccatggaacatatttacattttctttatcccttcatcaactgatgtacacttatgttgatactataacttggctatcacgaataatgctgcaataaacatgggagtgcagttatccctttgatatactcgtttcctttttttttggacggagtctcactctgtcaccaggctggagtgcaatggcgcgatttcggctcactgcaatctctgcctcccgggttgaagcaattcccctgcctcagcctcctgagtatctgggactacaggtgcacaccaccacatttggctaattttttgtattttagtagagacgggatttctccattttggtcaggctgatcttgaattcctgacctcaggtgatccgctcaccttgccctcccaaagtgctgggattacaggcatgagccaccgcacccaggcctttctttgggatatatactcagcagtggaaatgctggatcatatggttgctctattttcagtttttgaggagcctccataatattctttttttttttttttttttttttttgagacagagtctggcactgttgcccaggttggagtgcagtgcagcaatctaggctcactccaagctccacctcccaggttcacgccattctcctgcctcagcctcgcgagtagctgggactacaggcgcccaccaccacgctcggctggtttcaccgtgttagccaggatggtctcgatgtcctgacttcatgacccacccacctcggcctcccaaagtgctgggattacaggcgtgagccaccatgcccggcctccatgctattcttcatagtgactgtactggtttacattcctatcaacaacgtataagagttctcttttttctgcctgctcactagcatttgttattgcctgtctttttgataaaagccattttaactgggatgaaatatttcattatactttcgattagtatttatctgattagtgatgttgaccattttttcatatacctgttgaccatttacccatatgtcttcctgagaaacatctattcagctcttgtgcttcagatcttttgcccatttttaaattggatttctttttcctatcgagttgtttcagctccttacatattctggttattatctcatcagttgggtagtctgcaaatattttcttcattctgtgggttgtttcttcattttgttgactgtttgttgtgcagcagctttgagcttgatgtgatcccactgtccattttgttgtggttgcctgttctttggaggtcacactcaagaaaccttagcccataccaatgacctttagtgtttcccaatgttttcttctagtagtctcataacttcaggtgcttaatccattttgatttgttttagtatacggcaagaaataggggtccagtttcattcttctgcatgtggatgtccagtcttcccagcaccatttattgcagactgtcctttccccaatgttcttagtggctttgttgaaaatgagttggaggtaaatgtgtggatttttttctgggctctctattctgttccactggtctgtgtctgtttttatgccagcaccatgctatagctctggagtataatttgaagtcacataatgtatgtaatgtgattccttcagttttgttctttttgcccaggattgctttgcctactctgggtctttgtggttccacaaaaattttaggattgtttttccaaccctaaaacataattctgtgaagaatgtcattggtgttttgacaagggttgcaatgaatctgtaaattcctttgggtagtgtggacattttaacaacactgattccaacaatactgaatccatgaccatggagtatctttccactttttggtgccgtcttcaatatctttcatcagtgttttatagttttcattgtagaaatctttcacttctttggttaagtttattcctaggtattttattttattttatttgtagctattggaaataagattattttcttggtttattttctagattgtttgctcttggcatacagaaatgctgctgatttttatatgctgactttgcatcctgcaattttactaaacctcagttctaacagttttctggtagagtccttaggtttttctaaatttaagatactattgtctgcaaacaagggtaatctaaatttttccttccaatttggatgccttttcttttcttctcctgtttaattgctctggctaggacttccagtaccacgttgaagaaaggtggtgaaagtgggcttccttgccttcttccagatcttacaggaaaggcttttagattcccccctcatgatactagctgtgggtttatctgtctgtggcttttattgtgttgaggcatgttccttctacatccagttgagtttttatcatgaagggatgctgaattttactgaatacttttttggcatctatagaaatggacatatggttatgtccttcattcttttgatgtgatgtatcgcatttacagatctgaatatgtattaggtggttctcacattgctataaagaaatacctgagactgggcaatttatataaaaaaagagttcattggctcactattctgcaggctgtacagcaagcatgacagcatctgcttggcttctggtgaggcctcaggaaatgcataatcagggcagaaggcaacaggggaacacacatggccagagtaggagagagacagagagcagggaggtttaaacaatcagatctcatgagaactcactaactatatagtagcaaggggagatggggctaaaccattcatgagaactccactcctatgatccaatcacgttccaccaggcccctcctccaacactggggattacaattaaatgtaagatttgggcagggacacaaacacaaaccatatcagagtatgttgaaccatccttgcatccctgggatgaatcccacttgattacaatgaatgatcttttaaatatgtagttgaatttggtttaaggattttgcatctctgttcaaagatactggcctgtagttttctttttttgttgcgtctttgtctggttttggtaccagggaaatactggccctttggaatgaatttggaagtattctcttcttagcttttgtgatataattcttctttaaatgtttggtagagttcagcagtgaagccatcaggtcctgggcttttctttgatgattttctttttttcttttcttttattactgcttgctctgaaaatatttcttttttaattcaaaaaaccaaaaacaaacaaaaaacaaccaaaaaaccattcctggagggatggctggtgaggactttgattttgtcatagtctctctgtgatgaggctcagaggaaacccagctgttttcctagtacaacagttagcatattcaacaactgaagaattgtgagttatatacctctcttatctcaatgtatcttctgatgacattttctgggctgccctctcatggcaaaaaaataactgaggcacagaaagaagccaggtacaaaatggaacctacattaatcatctaaaacggcattatcataacagacttgcctgagccattacttaccacaatgaattggtatgacacttctaacaaggtcagaaaaatcagattctgttttcttaatattgaggatctttcccactttccctgagctaatgagacacaggtctgtggcaaatacatttagtattttcctacacatgaattcctaacaaaaccaagcaagagcatacaaagggaaacatactttagctaatttaaaggtgtcttatgttattttgcttattgaaaaaactgaaaaggtagtaaggaaaagatgtaatgtggtaatagcaaattgcatctgtggtctctaatgaataatctcgcttccagtaaaaaaaactatcaaaagagcttaaactcaaggtaaacaaaaggatgaaaatattaaaataagagcagaaatcaatgaaacagaaaacagaataaagaatgtcactgaaaacaaaagtaggtattttgaaaagatcaataaaattgtcaaacctctagccagactgaccaagaaataagacacaaattaccaatataaataatgaaacaaaacaaaacagcattatagaaccatccaaaattaaaaataagggaatattatgaacaatgttatactcataattttaacaacttacatgataaagacaaatattttgaaagacacaaactaccagtcaggcatggtggctcacgcctgtaatcccagcactttgggaggctgaggtgggaggattgcctgaggtcaggagttcaagaccagcccagccaacctggtgaaacaccggctctactaaaaacacaaaaactagccaggctggtggtgcatgcttacagtcccagctactcgagaggctgaggcaggagaatcgcttcaaccgcagaggttgcagtgagccatgatggtaccactgcactccagcttgggtgatacagcaagactctgtctcaaaaaaaaaaaaaaagactaccaaaaaacaaaacaaaacaaaacaaactgtaacaaggaaaaaatacataacctgaatattcctatataaaattaaagaaactgaatttgtaatgaaaacccttcccacaaagaaaactctagcaccaggtaactctactagtgaattctaacaaatatttaagaaaaaaataaaatcaattgtacatgaactctaccagaaaccacaaaaggaaggaacacgtcccaactccttgttttgaggtacagcttttccatgataccaaaaccagatataaacaatgttaaaaaaaagtactgaccaataaaacaagaatcttcacaaaacatcagcaaatcaatccagcaacatctggaatggataacatgtaaacaatcaagtagaatttatctgaggaatgcaaggctgttcaacaaacaacaagaaatccaccatatcaacagattaagaagaaaacccatataatcccagtcatacacacacaaaaaaaagcactgacaaaaattcaactttcattcatgattaaaaacaaccatctctcagtaaactaagataaaagggaacttcctcaatctaacaaatggcaaaatagaaatacaagggaacttccttaacctgataaaaggcatcaaccaaaaaaaaaaccacttactggtgaaagacagcttttacccagtattaagagtaaggtaagtatgcctgctcaccattcctaattaacaacatcctgaaagtccaaactagtgcaataaggcaagaaaaagaaataaagagcattcaaaaggagggaaaaaaactgcctctatacacagatgacatgactgcctacacataggaaaacacccaggaatctaaacaagaaagttcctacaactagtaattttaagactgcaaggttgctataaaaaaaaaaacaaaaaaaaacctgcatttctacacagtaacaaggaacaatcaaatattgaaatgaaaaaaaaaaaactatttacaatagcgccaagaaacatgagatatttaactataaacctaacaaaaatgtgtgcaggatctatttgccaaaaactacaatacattaaagaaataaaacaatgaggagataacattatattcatagtttggaatattcaatattgttaaaatgttaattatccccaatgatttgtagattcaaatgcaatcccaataaaatcccagcagttttattttctttgagggaaggaagataaaagttgacaaaattattctaaaatttatacagaaaggcaaaggagctagaatagccaaaataattttaaaaagtatttggaggatttgccctacctgatttccacgtttaatataaagctacagtaatcgatgcataagtaactggtaaaaaggcagacacacagatcaacagaccagacaagggagtccagaaatatatggtcaattgatttttgacaaagcgagaaaggcaattaaacggacaaagtataatctttcaaacaaaatgcttcttcaaaataaacactggacatctgtatgaaaaaaaaaaaatctctctgcccgtatctcatggcacaaacagaatttaactgaaataaaacttttaaaggaaaacagaggaaaaattattcttgattttgggtttggcaaagatttctgagatacaaaaccaaaaacatgattgataaaggcaaaaattaacaaactggactttatcaaaaatttttctttctttccttttgagacagagtcttactctgtctcccatgctggagtgcagtggcacgatgtcagggtcattgcaacctctgcctcctgggctcaagcgattctcctgcctcagcctcccgagtagctgggactacaggcacatgccaacactcccagctaatttttgtatttttagtagagacaggctttcaccatgttggccaggctggtctcaaattcctggcctcaagtaatttgtctgccttggcctaccaaagtgttgggtttacaggcttgagccactacacctggccagagctttatcaaaacttaaagcatgtactgcaaaagacactgtcattaagagaaagaaaaggcaaatcacagaatgggaaaaaaatacttacaaaataatacctgataaagaatctgtatcctgaatacgttaaaaaaaaaaaaaaaaaatctcaaaactcagtaacttctgtgtaccaaaaagaataatcacagagtaaaaaggcaatccatggaaaggaaaaaaatatttgcaaatcatatatttaacaactggttaatatccaaaatatataaagactactgcaactcaacaactaaaaaacaagcaacatagagcttaaaaatgggcaacagtcttgaatacgtgaagtctatgttgtattttgccgcaattttataaaatctcaataataagaaaaacccaattaaaaatgggcaaaaggtttgaatacattttaccaaagatatatggacaacaaatgagcacatcaagagatcattaatcttcagagataagcaaactaaaaccacgtgtgataccgctagatacccactgaatggcaattggtcttgctctgttgcccaggatggaatgcaatggcgtgatctcggctcattgcaacctccatctactgggttcaagtgattctcctgcctcagcctccaagtagctgggactacaggcgcctgccaccacgtccagctaatttttgtatttttagtagacggggtttcaccacgttggccaggctggtctcaaactcctggcctcgggtaatccaccagcctctccctcccaaagtgctgggattacaggtgtgagccactgtgcccagcgtttttttttttttttcttttctttctaaatctgacaatacggattgagtatcctttacctgaaatgcttgggaccagaaatgtttcagatttcaaatgttttggatttgggaatatttgcgttatacttaccagttcggcacccataatctgaaaatccaaaattcagaatgttccaatgagcatttcctttaaacatgacgtcatcactcgaaaagttttgaattttgcattttagatttcagatctgggatgctcaacccatatcaagtgctgatgaggatacgcaacaacgggagctcttatacactgccagtggtggtgttagatggtacagagaatttgaccatttctttaaaacttaaataattaccatgggacccacagcaagtcttttcctaagtatttacccaaaagaaataaaaagttatgttcatacaaaaacctgtacactagaggtttgttcataatcaatggaaactgcaaaacacaaatataccacaactggagaacgaacacacaattatacattcatacaatgaaatgctactatgcaataagagaaactactgatagagtaacatcatggagaaatcccaaatgcattaggctaagtgtaagaagtcagcctcaaaaggctacatgttgtatgagtccatttacatgacattctagaaaaggcaagaatgtacaaaaagaaaccatatcattggttaagtggacgtgaggggaccgggatgattaaaaataggtgttaagagaaagtttttgtattgaagttgtcttgtattttaattgtggtggttacatgactgtatatgcttgtcaaaactcagaactgtaagggtcaatttcactgtatgtaaattataccaataaaaacaataaaagtcttaataaaaataaatgtaatatgataaaaaaaataccaaatcattgacatcgccactagtcataaggtaagaagttattttatatgtttaatcatatgtatctgatttaaatatgctacctatcaatacatttcaaacaaaggaaggccatgttgcaggtttatgaaagttaaggttagtattagataatgatttccttcaccatttaataatgaaacattaaaaagttgactatatcttatcagaaaaaaaaatttttttttttttttgagagggagtctcgcctctgtcacccaggctggagtgcagtggcatgatctcggctcactgcaagctctgcctcctgggttcacgccattctcccgcctcagcctcccgagtagctgggactacaggcacccgccaccacgcctggctaatttttttgtatttttagtacagacagggtttcaccatgttatccaggatggtctcaatctcctgacctcgtgatctgcctgcctcagcctcccaaagtgctgggattacaggcgtgagccaccacacccagccaaaaacaactattttttaataattaatttacccattatctactatgtgcagatccaaacattcgtgagataatcaggggcagagtccagcaacatgattctttcccctttccatcttcctaataatggatatagctggtagaaatagtaagtgtaaagtgcaaggccagtatttaaatattctctctttccatacattctctaagaaagggagtaatcagtagattcagctctcttgaaagagaggaaagagaattttgagagacacttaactttacaaattggtaaagcatgaactggtgtcaacttgttccattttaaacttgtgaaaaccaaggttttcgaaggtgactgaatcacttccccatttctaaagcaagagaaaggcagaaccagaattcaaattgatagcagtctcacttcggacaaagttcttagtcccaccaagtaagaactcatctcttactactactcatctctcttctcgcatctgcaattgtttaagcaacagcttgggtcaacatgtttgaaatcaattaagtatcttttaggattttattatgcatacaacctggtttaatttcaaacttcactcccacaatggatgcatatatactcagaaaggttgaagcagtttataataatttatactaatgtacagagtcttttatctgatcactcaaaattttaaaagcaaatcactttttaagtcaggaataaaaacagcaaatactcaaaaggatatatgaaaaagtaatcatgctcacttttgaccttaataaaaaattattgtaactctaattttaaacaaaagaatatagaaaaagtttcctcctccctctggcttcctgacatctggctttcctctattgttttcaaagctgccagtatcctgagttatacacagattacttactgcaacacaaacttaccctgtgaagcgtcactgtatgttgttcccatatagctgtttcctccattgctgtgctctgataaaggaaaagaaaaacaaatcatttaccttttaagaaaatgtccttaataaggtgagcaagaacatccaacaattcagcacactgaaataccaaaattcacagttaatattagagacactctgaaaggaccttaataattatggaaagttttttgtttgcttttaagagacaggaaacgacacacaggaacttcctttgtttttaacttaatttggacagctgctctatattcatttcatgcaagctgaaatcagtattcaagctaattctgcaactttatacttagaaaagaataaaagttggagcggtattatcttaaaatatctaatggcacgtaaacatttaaaagcatctcttatgttttacaaacgaagggaaagttaaatgcctctgaacacagtaattataaatatacatgtcacaggaaaacagataaaaccattaataggtttggcaaatggctgctttaacgtcacaaacatgactactctacctagtttcagttttgctacagaattacttctcaagcttcatttataaccaaaagaaaaagaacagcttttctagtatatgtatcacacacgtagatacacacaagaaacaaaaacaaaaaagaacaatctcccaaactcccccaagaatcatcataaaataaaagcagtaagagctccaatacaggtcctgcccaaattatagcgtacttcagttttacctcctgtcatgagcctctcaatagagaggaaaataaattattattttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtacagacggggtttcaccgttttagccgggatggtctcgatctcctgacctcctgatccgcccgcctcggcctcccaaagtgctgggattacaggcgtgagccaccgcgcccggccgaaaataaattattatctaaggcaggggtgtccaatcttttggcttctctgggccacacttgaaagaagaagaattgtcttgggccacacataaaatacactaacactaatgaaagctgatgagcttaaaaaaaaaattacaaaaaaaaaaatctcataatgttgtaagaaaatttacgaatttgtgttgggccgcatgcgacctgtgaaccacgggttggacaaggttgatctaaggaattagcagtaaggaattcaaaataaatttcttttaaatggggttaattgctcttggagacttaaaatatttcagtctctcttaatgttaccattttatgaaactgggactcctaaaatgtatttacaagtaaatttaaaaaagattcttcagagttatcaaaaggtaaagtaaaaagggagaaggctaagcatgacactctcagatcactagtcacccattactataaatgcctatttcataagtgaggtctgttttctcttactgctgtcattagcatcatgagaatatgcctaccaaggtgccatgggcccattctctcctttcccacagcgactttaattgaagattaatgccattttagaaagtaagtccctataaagaaagcctgcttccctaaattcaaagcaactagattatcctgccagatgaataagagaggagagagaaaggatctctctgttcactcccatagataagaactgccaacctcaccagcatttgtttcaatcttccaatgaagtgcaccaaaacctccctttaatgagacctccactggaaacaaagctgtttttttttttttaaacaaacattgaccgggataatgcactaaaaaaaaaaattcttccatcaatgagaagcaacaatagtatgagtaaatcagctaaacatcaacagtcccactaacatacacatgataaaagtatctgcaagagttgccagtttgtccaatctcagctgatattaagaatgagaactgcttgcatagctctcagttcatcttttcttgatctatttcattaaccagtgacattgttttactgcctttttaatctttttcctatcagtccaaatggcaagtgatgtgataacatgcacttaactctctttgataacatactctatggtatgaaacagttcatcatcctctctaaggtcttaatgaacacagttttccattttgtaagaagatgttaatcaaatgggaaaatttatttaacattaaggggggagcaggttgtaaaacagcgtgtacatggttatcctaattttgtttaaacattagtagggaataaaggctcaaaggataaacaaaatgttaacattgtttatcaccttcaaagtaaagggactgtgggtgacatttttctatcaggtgttttatcttcctgctttcctttctccattccccatcagaacaaactggcaatgtattttaaactatattcacaaaatctcattcctatttgacatttcgaatacagacagtccctgacttaggatgggtcaacttgattttctgactttacgatggtacccatacaaccattgtttttcatttccactacagtattcaagaaattatatgagatattcaacactttattgtgaagtaagcttttgtgttagataattttgcccaactatatactaatgtaagtgttctgagcatggttaaggtaggctgggctaagcttatgatactgggtaggttgggtgtattaaatgcatttttgacgtaaagtattttcaacttacgatgagtttaatcaggacattgttctaagtgagctgagaagcatctgtatctgtttttccacttggcttttaggaaaatcaaataatgcttaagaggattaatgttcttattgttaattataaaaaatgtttattctcctgttagtaagcaatctatacattaaggtcttaatgtacagtctccaggaggagtgcaataagagaaacttgctttgtacaagggagaagactaaaatactaaaacataattgctctcaccattccacatcaaaatcaatatagtttttctttggaggactggaaaagtccacatctcaaaaaacttctctgttaaacatcaattatagcttgatttatctgaaggaagacctatgtagaagaaagtaattgagaatgaaacatcaaaagaagtggttaggctcttgaccagccactaaaccaacttaatccataatataagtgagttactatgttttaccactccttatctttaaaaaaaaaaaacaaaaaacagaaaaatatattcctagtttaaatgatggaccatgtcatctctctccattctctagcctttcatttgcttctgtggcaaaagtagcaaattctatccatggttgtttatataaccaggcagtactgatgaggagttctgaatgaggaatggaaggatgaacaaacacgtaaatatgtaataatgcaaatacagtaaaatgataatggtagaatcttagtggttgggattcaggtaaccatggcagactgctttcaatcttgttacgtgtttgaaagtgatcataataaaatgctgaggaaaaactaagaaatccttctagtaaatcactcagaaatcaaagctaaaattgatatgagacatttttagtaccagtaaatttattaaccactattttaatgagcattccataaagaaaaaatgttcactaatgactgagaattttgatgcattagaaaagcaaggggtgtggaggttcctttggaagaatacctaagaaacgcatggcttctggagtggagaaaggaaaaccaggtaggaggagtctcacttttcactgggagccctttgtacttttaattacattcatctattacttatcaaattatttttaaaacttaatatccttattgtaaacttgcttgtcattttctcatttcaaacatgcacaagggataactgcataacttgcacaaaaagcttctggtaaattaccagtctcaggttcaagacatttaggcttgtaggagaccaaggggaaaatgtattactcctctaagcatgattctagcactaccattccctagtaactcagacagatgctggtaaacaggaaatgaactagaccaggcataaggagaccagagccgaaaggtatcatcaactagaaacgtgatcttaattttcctcacctacacaattagggaaatgggtgaaattatctcaaatgaaaagacttttctagctccaaaattctatcagactataattccaatgaacaggctacaaattcaataattagtgaagcactgcaggcatcaaaagtgactgcaattcatggttgctggattctgagttctgcgcacatttctaagtcagcatcaactgactagaatcacaatttctgaagaagcaaaaagctgtatttcacaatctgccaagagtttgtttagtttctttgttctaagctccagctggcaaagacactactcagatcaccaactctgaagggcttcctgccaaaacttcagatcccagttctaggcagtttcactgtccttcaggactgattactgaatggggaaagataggagggcacaataactgaaaagacaggatgagcctataactgggagaagaacaaatccaaaagagaagatataaagtatactccaaatgaagaactccttaacattatctaaatacacagccagttaaattttactaaccttatggctgtaatttcaaaaccaatccatgtatcattcattcattcattcattcaacaaacatgtatcagacatggtaagtgttggggaggccaaaaaaaggtccctctccctccctaggggctcaaagaagcagctgagaacactaaatggtatttaggttggtgcaaaaataactgcagcttttgccattaaaatggcatcaaaagatatgagctttttgcaccaaaataaataacttttgcaccacatagataagagctgttatggaagatgcaaaaggactgtgtctgctgtgaagatcagagatctgttccctgagacagcaacgttttgagttcatcaagcttgaaggatgtccaggaaaaaagtggagaaagatgtttcagaagaaacagcatgtcagcaagattgtgtgatgctacacatgacgctggctttgatatgactaagttgtacaatttatggaacaaggagagagtaaaaggagagaaggtgcaagggtaccagatcacaacaggctttataatataatgccaaggactttaaactcaaatggaagacactaaagaattttcgacgatcaaatgatataagaattcatcctgaaggctgtaatgggaaaatgatttgagaaagggaaaccagttagaaagttagtgagaagtgtgggtggagttcaaaatggctcttgagtagtcaaccaagtagcagtgctgaagtcaaaaggaaaagatgtaattacccaaggactaagataaccctgtggacaaccaaaggaatttgagaagaagcagacaatgaggatacatgaaaaccaatggagctaatacaaaacactacttactgtccagagaatacaccaaagcttaagatccctcaattttttagatcaatacacctcatttatctgacatcataaaataataaaatttccacaaatcttcaaggaacaccctttcttgatgacatgcagttccccattaggaaaaccaatagtaaaggtattaagaacactctgtgaaccctccaagttccttctgtgagcaaagctgctacactgaacggcttctcattccttctgaactccaaagtgtttctgttttggtctttttggcttttttccatccaaattgaaagcaagatcatctatggagatgaggttgagccaggaacttaaggagaaggacaaggtaggtttcagtgaataaaacagatgacccctgcccttcaatgaagtttcaattacataatttcaaattgtgatcactgcaacacaaatgaagtacaaagggaatagtgctacatgttaaaaggtaaggcaaaatatgtatatttggactgatctgatgggccgtcatttaaattcccaaaatagaaatgtccaggaggtagtaaaaaagatcactctaaaataaaatgaagaagggtcctaacgatattcagggattcaacaaacttcatgaatagaagataaaaattcaggaaacataagaattaaaataatgatcaaaataagaaggcagcaaccataggataaaagtctcaatagaaatttagtaaatttagcatccaacaccccactgtattcaacactggttaaatttacaaatgtatcactgtgtccatcccttggttaacagtttaggaaacaaatgatgagatggatatgattaggaaatattagtcggaaagacagacacagtgaacctgtaattttctggttgatcaaagctgaaggtctgctaaaaacattaagttcacagataagctgctacattagctataaagtaagagtgaaagaacatcagcttaaaagttaccattatgtgtacattaaatattgagaaaatctcagtagggacagttacaaatattcttggaaacttaaaatctagagtgctttcaagttatcaaaaataaaactatttttaggtatagcatcttctaaaggttgaagatagatacaaagatctctcacaatttattcaggtagacaggaggaggaagggaatggcatagcagagatgaagagagagtgacagtcctctgagtatatctttttgcataactctctttcttagaccacagtattgtttcatgacattacccttcacagatcaaaaaattaaactattaaaaccaaaaagacatgaggggaggggaggaaatcaaaaacagaataaagacagtaacaaatgaacataactatattacagatggagaatgtaaccacactaaagaagagtttaacttttctataaatctaatattttaaaataaaaagtttaaaaaagttataatggtatagaaaaatgcagaaagataccaattttggaaaaaatatttacgtactcagaaaaaaaacttggtttcagagttgtatattttaagtttttatatatcctacaatgaacacatgaatttcataatccttgaaaactggtaaacatcacatctgaattacgaaacaaaaaatgggcaaaagtggccaggcatggtggctcacacctgtaatcccagcacttttggaggctgaggcaggcagatcatttgaggccagatgttcaagatcagcctggccaacctggtgaaaccccgtctctactaaaaatacaaaaattagccaggcatgggggcacatgcctgtaatcccagctacttgggaggctgaggcacgagaatcacttgaacccaggaggtggagtttgcagtgagccgagattgcaccactgcactccagcctgggtgacacagtgagactgtcttaaaacaaaaacataaacaagaaacagggaaaagtgatctacactgttagaagttgggacagggttacctttgtgtatgaagtaactcgaagggatggaggtgggggagcttcgggacgtaaagtaaatgttcttccttgatctgagttgtgggcaaataggcatattcactttgaaaatatatcaatctgtgtacacctatgatttgcctaatgtattatgttatttaaaaattcaaaataaagtaacctgacagaactgtaagtaatttgactgcaatggattaaaataaatcaaatatgcttccatccatccatatgcccacagtgattttaaaaaatgataagtgctggcagaactcattattttgagaaactggtacgtatagggaaagaataagatatttactctgtctttcctatacaaacagtaccagtgggcgatcaaaatagtagatgaaggagagtttctttttttagaagcactccagctaaccaatgaaaaaggaataataaaaattgaatatcatcattttgtaacacctagtgaattaagggatctacacactgatcatcaatggctgcagacatcatccaaaaacaacagaaaaaaccctgggaccgaatgccacttatgaagtagaactgtaaaaacaaacaaaaaaatcaaatctgaatctgatcaaggctctagatctgtgctatccagtacagtagccaccagccacatggggctactcagcacttaaaatgtgggtagtccaaactgagatatggtatatgtaaaatatatatatgatacgaaatatgtgatatgtattatgatatgctatgtgcaaaatatacatgatatgtaaaatatacatgcaacagtattcagagactgaatatggaaaataatttaaaatatctcacctataattttatatcattgcatgctaaaatggtaatattttggatatgtgtgttaaataaaacatgaaaattaattttaccttaaagttttggtgtggctactacattagacagaattgctctagctacagttaaccaatttacaggaaatacagtgggccaaccaccattgtaatcaccacaaggaagcaaataccaaaattcatactgttaaaatttctacaaataatcctgtttctcaaccaataaagctgcaagggaagaggggaaagagagagacagaaatgggggacctcatatgcctaagagaaatgttaaacaatcacagtaagaggacctcatcaaggaaagttgacatttaacacaattagaaaacactaaacatggctgggcgcggtggctcacacctgtaatctcagcacttgggaggccaacgggggtggatcgcctgaagtcaggagttcgagaccaggctggccaacacggtgaaaccccgtctctactaaaaatacaaaaaattagccaggcatggtggcagatgcctgcaatcccagctactcaggaggctgaggcaggagaatcccttgaaccagggaggcagacgttacagtgagccaaggtcatgccattgcactccagcctgggcaaccaggagcgaaactccgtcttaaaaaaaaaaaaccaaacacttaagtacttgatttggagtttattttaaaagtgtgctaatgataatgtagttatagtacttttaaaaaagacatcttttagagatatatattcagacacatgttgagtattccattctatctcttctctgaaatgcttcaaaccacgtgtttccgatttcagggtgaaccatccaaaatccaaaaatctgaaatctgaaatgctccaaagagaattttctttgagcattatgtcagtgctcaaaaagtactggattttgaagcatttcagatttgggatgttcactatgtactaacagatgaaaagatatctggcatttgcttcaaaataatggggaagagaagacacaatgaatgaagtatagatgaaatgagactggctgtaagttgttaaccatactgggtgacagtaatgtgggaattcattatattccccacatccacttttctataggtttgaaaattttccacttaaaagaaggtaacttgaggggactagaaattaattactgatttaggaaagacccaaaccaagaatgcagctaccatgatgccaggatattaagtagtatttccatgagctggctattccagcaactgcttcccctcccctttcagaatagtaagaaaaatgcaactagtcctggagatggattagtaccttccttctgctgctaagctgaatttaaggtggtctaacattaccagtaagtgagttaacagcattgaaaaggcaactcttgtctagaaggggtaacagatactaatcaaataatagcagagaactaagtacaggttatcataagtgctataaaggggtacacagagtttaaagcacagagttttgacctagtttctgggctctgggcaaagtccttgaggagaagagacagctatgaggtgcatgaaagatggaggtggcaaggtttccgggtagaaaaaacagcacgtgcaagagcctagtgtaggaaagtgcatctctcattcattcaaataatgttttgagagtttcctatgtactagacactgtgttaaactacacgaataactggacacaactagtatgacctttgttctcaaggagcttacagtctagcaggagaaccaaatgatcgaaaaactccatggctaaatatatagtcacaaagttaaataagtactatgaaagaaggaaaaacagtgccatgaggaactcaaagagaaagttgacaggaagtacacttgctaggaaccaaaaagaggaaagcacagtttgagaacaagaaacaaggaggaaaaagatacgatgtggctagaggggtaggcaggggccaaataatccactaggagcttactgaccatattaaggattttgatcttttactctaaaggtagttaagcagcctaggaattttaggatgagtgttcgcatgtgtgtgtagcggggcgggggagagcggagagaaactaatcaaacctggattttgaaaagattatttcagaaaaacagattgtaaggggaagaggggggtatgatacttaggaggctattacaggaatccagagggaggattacttgggtgggggtgggggggtggtgggagggagaatgtaaatggttgaaagtacggataaaacaagtagaaagacctgaggtgctcagcaaatcaaagctgaatagaacttgctaatcaaccattcaccatactaggtagacatccaaattgagccaggtaccctggatttggaatagtctttcaactctattgcctaatccatcagactaaggactgtatctcttatctaatgccattgtaataattttttcaaaagtatctcaggaacccaaggaaccttcctctgaaaccataaaacatcttgctgggctgaaactactaacctacaggctgattgatctttgtccagaaataaataaatgaatcctccttctgaaaccacaaaacatcttgctgggctgaaaactactaacctacaggctgatctctgtccaaaatgaatgaatgaatgaatgaatgaatgaatgtcttaaataatctacaggccaacctttgtccataaataaacaagtaaataaataaaattcctatatgcctcctctctgatattaaaataggcttcacttaaaatgtttttagaagacacagctaacataatagcttagtatgtgctgagcccacaatcactctgagatgggtcttgtttgcatttttacatttgcattttgtgtacagatgagaaaacagccatttagtggcagactcaggattcagattccagaggctaaactcacatataagtaaaacttaagagttgctcggtgataatcttttcagtccttattttacttgacctctctgtgcaggatctggcctgctgacaggtgaatggtgtttacacgggtgttcactttataataatccattaatgtacatttgctttatgtacttttgtacacatggcaatatatttcacaataaaaagatataaaaaactaagtcaactagcaagacttaagtcagggtaacttacatgaaaatccggatttgcaacctcttgaaaaactgggagatctggcctgtcttcttccaagaaaacaatcagctggggctgagcaagagctgcttcctttagacaaactggcttgtgctctgatggagcagtgccctctcttctggctttcatgattcatgctgcttttctggtctaagacttacctaacaccatcccatactcttctccctggtgctctcttacaacacacgaacataaaaggatgtgaatgtatgacttatagaacatgtaagtagatgtatgattacctatggcaagtaaatttaacctcagatccttcacctgtaaaaacagagataatcgtagtatctaacagaattgtgaagattaaatgggataatgcacataaaacacttagctcagtatctgtcacagagtcagcatgcaatataaggggctactgtttgttttgacacatatttctcacacttataactaaaatgtaagcctacttgccatggctactgacttgatttttataggtgatacagcatcaaaatagtgtacttctgtattaacactccagtaagtattaatactccaataactgccactgttagaaaaaaaaaatcagtaaataaaccttccttagtacctttatatgacattaccaggaaaaacttccacaattatattttgaaaggcagactcatttttgccagattcatgtatttcccctgattgtggcttttggtggtctgatcagtcaggtaagtggatatcttactactaaaacatacttcaatacttactactaaaacatactttagtatgacaaacatcttagtcataaaatatcctccaaactaagaccaacttgatttttcaagataatcataggaacaccaaaagaagcttactaccttttgctcagctgttggtactccaatgactgcctcataatgcatatctaattcttgcccctcagacagacatatacaatatttttctccaaaaagccacagaagtctaactgaaactattttctcccgaaaccaataaagtcctcatacaatggaataccatgaagtacaagaactgaatgaaaactaatgagctacagttctccacaacataatcttacaaacataatgctgagcaaaagaagccatatacaacagaattcacactagaagattctgtatgcgcaaagttcagagagtcaaaactagtgctttcagaatgcataattaggtggtaactataaagaaaaactagaaaatgagaaacctagaagacaagatacatgcaatctttgaagaagggaggatatgacccagaaaaggcatgttagggattctagcacttatcattatggacagaattttatttgctgctctctacccgcaccattaaaatgccctatcagtacagagatgtgttcactgctgcatctccagcacctacaacagtgattggtacacacgaggtaaccaacaaatatctgctgaatgtaaaattccgctttaggaatccaaattgttacatatttcacagcttcttgaaccctaaatgtaacagtaacagctagtatagtgttcatttgccttgtcagtatattcaaggagctgttaagcatataagccaattactttataattcttaatgtctccctcctattgagatattgataccaaacatatgcagaaaacacttacatcaatgtatccagattcaattcaaacatttaaaaacattaacaaggaaaaatacagaaactctgctaaacagcaagcccaggtttagaaaatgactttgtcacctcctccaacgaagaaagcacacaagaatgctctgttattacaggatgaccataagtttgctcgtatttttaagagtaaacaatgcaaatcctttgtttcttcaacaatgagttacacaattcacaaagtgatcattacagcgtatagcagttgaaaactgtaaatttctaggatcgggatcccaaacaaaatgtactcatttaatatgtgttaagctaacaaaaagaattagtcattactggtatcctcctgaattttaaaattacatactaaattaagtgagctaatcttatattaagtttaactggtgatattcagttaccagaaactgttgtacaatctccaagataatgacaattccaaaagcgtgaaaattcctaagataaccaagaagaaaaatgaacttttcagtctttgggaatttacatttttttaaaaaggaaaaaatatttcggtaagtcaaaaaaaattaattaaaccaggtatacgctaatcttatgttcctaattagaatccacagaaagtaatatcagcttctgttttacctcctttccggacatgataaactagaattgagatcattcaccagttaactcacttcccagtattttcagtatatcaactgaaatatatccgcaacacaaactaataaaaccttatctcttgatctatcccaaagtgagggccacctgagattcagtattgagcactacatatatgacagggttttgttatcacatttcaaatggtgttttacagtacaaagtttggtaacattggtgttctcatgatctaaagctgtgttcttgtggtaaaggcaatcattcagagtccatttattttcatccatgcttaggatataagataaaactccctacccacgtattccccacatactgctcattattaagaatttatctgtttaagaggaatggaaataaagcacctggctagcccataaaggagcaacctgaagccactcttctctgcaataaataaataaagatgcactctaggtcagagagagcaaaagtcttatttttattgctggcttatgcaagaaatactgcaacacaccaattttataggattaactttaaaatctgtaaactatcctaatgtctatttctttctacaagactaaaagttgttaaagtaaaaaggtttttcaagatttgctttcaaaattcagaggtgcaaagcaagttccagtcaaatattccaggaggatcattctagacataaactatctttttatttaacatatcaaaactttgctaattagaaatgactggctcattccactagcttgtcttcagctactataatgctcagtcatacacaatgctgagcacgtgaatgctttcaggcaggcctgaaatgagcaatgactgagcagtcacagatgggtggcactacacatgaatttacagctggactcatggtctttcagtaaggtgaatttttatcatatcaggggtatgtcaagtaacaggattacgtcttcaaattttccaccaaaactattatttttaaagacattttccttagcagcatggtgatctatcatatttatacacagttttattcttagaactgtacagagtttacatttggtctctaaacagaaaagagattaaagagcaagtaaaagtcagagccagaccttgtttccaggattggaggggaaaaagggagtggaactactgtactttttttccttcaaatcaaacgggaagcagtactacatatactgcgttacagccctcgaagccacagattggtttccacctcattatttattggtgtctttccttttttttttttgagacagactctcactctgttgcccaggcaggagtgcagtggtgctatctcgactcactgcaaccttggctcaactgcaaactctgcttcctgggttcaaatgattctcctgcctcagcctcccaagtagctgggattttaggcatgtgctaccacacccggctaatttttgtatttttagtagagacggggtttcggccgtgttggttgtgctggtcttgaagtcccgccctcaggtgatatgcccgcctcagcctcccaaagtgcagggattacatgcttgagtctggcaaattggtgtctttcctaataatataatgtaatttgtgccaatatataacctgggggggaagaacaccacaatttgaaacataactatcttatgaagctgtcctgaaacaaatgtaagagttgtaaaatgtagttaggattatcagccaactatataaattaaagctttaaccatgatggtctaaaatgccaaacacacacaaaaattattgctacagtgaggatcattaaaagttggcagccaaacttcagtgacttctcacaaactacagtgagtttttcacttttaaaacagtatgaagcaagtatgcattgatcagtaactatcataattaaaacactgcatcactcactcaagaaacaatccctatatgtaatgactgactcttgtcattaatttttgttcattagcttggccattttctgcagctcttaaggtttcaaaaacgttaagatatcaagaaaagcccactgtatacacaaattaactcaagatggattaaagacttcaatgtaaaacccaaaaccataaaaaccctaaaagaaaacctaggcaataccattcaggacataggcatgggcaaagacttcatgatgaaaacaccaaaagcaattgcaacaaaagctaaaattgacaaatgggatctaattaaactaaagagcttctgcacagcaaaagaaactatcagagtgaacaggcaacctacagaatgggagaaaaacttttgccatctactgatctgacaaaggtctaatatccagaatccacatggaagtgaaactaatttacaagaaaacaaatatccgtatcaaaaactgggcaaagaatatgaacagacacttctcaaaagaagacatttatgctgccaaaaaaaaggaggtatttatgcggccaacaaacatatgaaaaaatgctcatcatcaccgatcattagagaaatgcaaatcaaaaccacaatgagataccatcttacacccgtcagaatggtgattattagaaagtcaggaaacaacagatgctgccgaggctgtggagaaataggaacgcttttacactgttggtgggaatgtaaattagttcaaccattgtggaagatagtatggcaattcctcaaggacctagaaccagaaataccatttgacccagtaatcccattactgggtatatactcaaaggaatataaatcattctcctataaagacacatgcacacatatgtttactgcagcactatttacaatagcaaagacatggaaccaacccaaatgcccaccaatgacagattggataaagaaaatgtggtacatatatacaccatggtatactatgcagccataaaaaagaatgagttcatgtcctttgcagggacacggacgaagctggaagctatcatcctcagcaaactaacaccagaacagaaaaccaaacaccacatgttctcactcataagtgggagttgaacaatgagaacacatggacacagggaggggaacatcacacaccaggacctggggcctgttacccgggttggtggtggggggaaagggagggaaagcatttaggaaaaatacctaatgcatgtggggcttaaaacttagatgatgggttcataggtgcagcaaaccaccatggcacacgtatacctatgtaacaaatgtgcacattctgcacatggatcccagaacttaattaaaaaaaaaaaagcccactgtgctccacttgatacaataaatcaattcctgggtatcatgtaaatcagtgtaacagtaaaaaatgacataaatcattttcatacttacattataatttcagatagccacagcgggcaatactactattcccgagacttaacaaaaacatttaagtattcagcaaaatctaataagcatatacaatagcacaatcttaaattaaattttattgcttcctccaaaggaaaacagcttgaaaacacagaagccactgaaacttccttcagccacttttctgtgattcaaccaatgaaatcgtttcttaacaatgattcataccactttcttacacatttaaacaattctttggtgacgcagagaaccaccctaattcttgtttttcaactttctaataatcttaaatcaaatacaccagtaaacaaaattctgactgcgaacgcagacgtttatcacacatataaaaaacgtttttttcctttatttatttatttgagacagcgtctcgctctgtcgcccaggatggagtgcagtggtgcgatcttggctcaatgcaacctctgactcccgggttcaagcgtttctcctgcctcagccttcccattaggggggattacaggtgctcgccaccaggcccggctatttttttttttttttttttgtatttttagtagagacggggtttcaccatgttggtcaggctggtcttgaactcctgacgtcgtgatccgcccctcctggcctcacaaagtgctgggattacaccgcgcccggccacgttttttccttcattactttttgtttttgagacggaagctcactttgtcgcccaggctgtagtgcagtggccccgatctcagctcaatgcaacctccgccttccaggttcaagcaattctccttccttagcttcccaagtagctgggattataggcacgcgccaccatgcccggctaatttttgtatttttagtagagacggggtttcaccatgttggccaggctggcctcgaactcctgacctcaagtgacccacccgcctttattacttctttagtatcatgcacggaggattcttttcaatctaggtacatacatatttttaagtagtattctacattttcttctattttagaatttttattgctctttgtcatttagatttcctttgattttttttagcctatgaggcagaaaacatttttaaaaaatggataaccaatagtcctagcaccatacattgaacaagccactttctccaatagtctacaatattattttttaccacatattcgtagttttccaccttgctggctaaatgaacttaaaagttatcgtatctctgtgtttcaatttcttcaccaaaaagtagagataatagttcacttcatagggttactgtgagaattaaataaattgagcacttagaacaatacctgacatgcaataatactgatgatcataattactaaaagcccataaatgcacagatgtttctggacctccctggttcctgaactgacgggctgctttaaatgactgtgaatttctaacaagtttcctgatacggccttctttttccaaaattttgtcgctatcattttatcatgtaggttttcttatcaatatgtcaagttttctacaatacaacactagaagacactgacttggggaaaattagtaaattctacaacagtgactgtctccatccagaaaatacattgtttcatctcgtttattcagatctcactttatgtccttcattaagattccagtagctcaccaatatttgttatatttatttctaggtagtctttttagagaaacatttagtagtatatatcagaatttaaactgcacatagcctttgcctcggtaattccatttttaagaatctgatatacagtaatatatgtgtacagatataaaaaggctactattccaagaacaaaatcctggaaacaaatgtctatcaagaaagcaaagataatctaaacagcagcatattcataggatgacaaactattcaaccattataaagaaaaccgaatcaaaagcactggcttattagacaagagtttcccaaactatcatgctaaaacagtaacagcgagcttccaaattaatgttgcctttttttttttttttttccaaactgaaaggagggtggggaaaacaaacgcatcatatgtaaagcactgagtccagcctggctcttagtaagcattttaatcaccttcaaaaattaaatgtgacttacggaaacaggtcactgaatattatttcatttcacttattcatttatggcctgttttgctctatataaaattctgaagtggctccataatacagcatcttaaaaaaaagctttcaacttgccctttactcgcaaatgtttacaatgcaaaaaagtccctacaacgtaatatttaacgagtgatgcttttcaatatgccatacaaatctcaatactataattcaggagaagtactcctcctaccttactgtggcaatccattgaaaacgtatttctctccatacttgaaataacctcttaaaaagtgtgttgtcttgcatattaagtaccagagatcacacttcaggaacaaagtgacattctgtgtaatacggaaacaaagcctttcctcctaggaaagaaagccccagaaaagacaaataatgggagcttattttaaaaccaaagcaaaatgttgccttttatcctaaatctctggatcaagttttacctttagattgttcttcctcaatgtaaggtcaaaaggtgcaagttaaatttttcttaaacgaagaatactatatcccttaaaacaatctattcattaataagtgtaaccgctagcttctcccagccagcaaacaagcttctgtgagagttcaaaagtttcagaggcatagtattcctgctcccagatgttacgggtaagcatttcaaacaaaaatacacacagaaaaccactacctgcccaagtatctcgatactatttgaagtaatgaattgatattctttaaaggggagattttttactcctcacatttctgtattcctttgtttgaaataacaagtactattttatgatgaaaaaattaatatacaaaatgggaggagcatcctagctgtttttcaggaactttggctttttaatgtaatacacaagttagtttcaaagcaatgggaaaatgcaataatatttcagagcacataggaaaagtaacaggaaaaacgttacttttttcggctgaactcaccggcctttactaatttttaagtgctcatcttattgtccattcgtaggaatactttgtattacttgtgaaagtttaattcaagttaaattattaaatgttaaagaggttattttcaaagttaccttaaataagtaatacagcatgaaagaaaacccgacctactacgcctcacaggctgagtggagtgttttgcagtctcaaagccttatcgctggcgtgcgcataccgcagggagtgacatcagatcgaaactacagggtttcgccggggaccaaccactcctccaaagacagcagctcccggccagcaggaggtggcaccccaagccccgacccgctgagagccggcttccagcccccgaaccctcactggagccgagtttctccgcgagggacctgttgcgtgtccccgccctcagcgagccgcagccaggcacaggcgccggcagctatgcacctgcccagtacggcggccgggcgcccgcagccccctccccggccgcccccagtgcggcccgcgccgcccccgcccgaggggctccccgcggcccgcggcccgcggcccgcggccccgcgccagccctgcccaccccgccgccccggggcccagacagccgccagcgagggagggcgggacgcgggccagatgccggtgggcgggcggcgacggtcggcccggtctggccctggcggccgcggaggcgctcaccttggcggccgcagctctggcggacatcttgtctctctccagcgccgcgcgaggctcctcggacccgaaactccgcggcgctggcccgcccgctcctcacgccacagcccaaataaacatctcccgagagcgagcggggcacgggcgggggcggccggaagggcccggcccagggggagggaattcaactcggacaaaagtccgggaagcgcccgccccgcccgggtcttctccacggggcgcgcccgaccggcacctccctccgagcgcggccacccactcggcctcccgcagctttcgcagcccggccacgtcggcctcgcccggtcgcccgcccgtcagcagcacccgtggcctcccggcgtctcctcggaagccggcttcgccacgtaacttcccgggaaccggcggccgccaaggaacgcggcgtccgctggctcagccggcgccggcaactcagcggccacgcaaacctgccggcccggcccactgagcatgcccggcccggcgggggcggggctggacgaggcgaggcgaggcgaggcggggagggggcggggccgcggcgggggagggggcgggacgagcggccggggtcccgaccccaagcgcggaaggaaaagccgggtaacccaagtaacttggaagacagtttccgctgccgtgcgagtcttcctgtttgtttttatccaaggtctggcagaattcgcccccaaggagaaagcgcctgtgcaccaaagctttccttaagagacttgtccacttgctcctcgacaagccacgcacatcatggggtgagccccatgcatgagtgcggctggaaaggccggcagagccgatacccgacagttgtttccttcactgggcaaacagcatggtcacggctgtcaccgcgtgcctcggcgttgttcccacggaaggcggaatgcattttctgcaaggcgcgtcatggctttcatctccgaggagctccggcagggtcagaagcgttgctctcgttcaccggcgccgactgccaaggctgaaactggtgatgaggtcatgggcacccggaggcagcagcctgagaaacaccctagagacctgtgacatctcggcccacaccccacattagacctcaagatatatccaaagtctctttcccgcccatctagacaggaatcttgaaaagtttatttttggccatcaagattgctgaaattcttgttgaccgaacgggtcaagctgccctgcattccaatgctgtccctccaactcaaagttgggcagaaaagggtgtaaacacgtgcagtccatggtccagtttaatcagccactacacaaacttcccacaatgttgacggctttgctaaacaccaaggaacatggtaagaaaccaatcctagactcactaatctacacttgtaaatgtaaaggtcttcaaaaaatgccagaaatccttagtaacatcaatgataacatctttaaagtatctggtatagtgccacaaccggcacagaagaaatggaagaaatcataaacatcaggctttagacaatggttttctctttagaattcaactgtatgaaaagaacaaatttaacaaagaagtatgtgtaggtgatacataagtatcaattaaggcttcgaagtgccacacatcttgcaacccaaagctgtctgaaccagaaaagagccttctgcaaaccaaacccttattcctttttgttcttcataaaaatggttgaagtcatttttgttttaaagtcatgttgtaattgttttgcttttggacaaagtattatttattcttttaagaattgtgggccaggcgtggtggctcacgcctgtaatcccagcactttgggaggccgaggcgagcggatcacgaggtcaggagtttgagaccagcctggccaatatggtgaaactccgtctttattaaaaatacaaaaattagcctggtgtggcgcgtgcctgtagtcccagctactcgggaggctgaggcagaagaatcacttgaacccaggaggcggaggttgcagtgagtccagatcgtgccactgtactccagcctgggcaaccagcaagactctgtctcaaaaaaaaaaaaaaaaaaaaaaaaaaaaaaaaaaaatggtggccaggcgtagttgctcacgtttataatcccagcacttggggccgtgcgcagtggctcaagcctgtaatcccagcacttgagaggccaaggcaggcagatcacttgaggtcaggagttcgaaaccagcctggccgacatggtgaaaccccatctctactaaaaataggaaagtagccgggcatggtgacagacgccagtaatgccagctattcaggaggctgaggcaggagaatcgcttgaacccgagaggcggaggttgcaatgagctgagatcatgccattgcactccagcctgggcaacaagagcgaaactccgtctcaaatcatcatcatcatcatcatcatcatcatcatcatcccagcactttgggaggccaagaccagaggattctttgaggccaggagtttgagaccagcctgggaaacagtgagaccccattaaaaaaaaaaaattgtgattaaatttcttcatatgcaaacaccatttaaaaaggtttgggaagtattttttaattttaaaaggtggtgatgaaagacctttcacattatctttaccatttaagaagatgtgcaattgcataagctgcctagaactaggtgtggtgtctttaatagcacctaaatctagagacactatctacaaatgcactgacatttttcacttttccttatttgtcacttttacaagttgcccaatgtgtaatttaaatgctagattgcaactatttgtcactaattaaaaatagttatatatttaacagttttatctttgccatggtttaaaaaatgaaatcaaacaaaaatatttcatcttgaaaatattattctttaaaaattatatttagtatttcagtgactaatagtatcactttaaaatttttcagtggtatttttaatatctaaattaaacttcataaagtctgttctttaaataaacaagagaaggcttttatcatctgtaaaataaaggtaaaactgttgccaacaattaaaaacaaagctttattcctgcagtttattttttaggtaggtgctttgacaacaagtggaaagtataaagaataatctgaaagaatcacccatttaacaattaaagagtttatccatggaacaccaaaaaagtattttctgacttttatgcttacacacgcatgtcatcatagctcctctagatcaatatgggaagaaatacaagttaattaaggattctcatttagagttactataatgtttaaccacaaatctctttcgattgtacagatttatcttatttctgatcatctctgcaactgaacaggaaactaaaaaaccacaacacttaaaagacaacttcctgtgggatttttggtgtctgcggctcagaatgaaaaaagcattatgtgtgcaaaatctttacacattttagatagaactacttaataaaacagccttgaccaaatgaacaactatatccacacctaatttgtatatatgtatatgtatggttttaattgcaaaaaagatccttaggaaagcatatttatgttatttttatatgaactgtgagtttacgcttgacaaagaggaagtatttatttacggtagtgaagcattagacaatctcgataatgtcagagaagagaatatatacaaaatattagaaggagaagcactttatcaagatgttataacaaccaaaagtaatcctgattccactcctatgccataccattaaagattctacaaattgttacagaattttcctctgccaataaagtcatgtaacaatgttaaatgggggaaagattcttttaaggctcataatgtttctaaatttcatagaccagtaaaaattttaaaacgatcttagaggtgcaatataggagtaccaactttttaatcttataaagtaaaaacattttaaaacaaacattataaactgtatatgtaaagataattaaaatggcaaattttatattatgtacatattaccacagtttagaaatacaaaaagaaagctattaccaacaccatttcatttttttttttttaaaaagaagacataaacactaaaaaacaagtctttttaaattcaattcagtatacagaaagttattcctcgaaagaattcctcctatggggctacccttacctctgactggggctaaggtggagttttcttttttcagggtcccaaatattgcacaaccaggcaggtcggaagctccataaatccatgactggaatccaggcaggctggcatacaggcctctggctcatcccttagcggtttgtcctccattcttcacagcttctccactctgatctacactttcctatgattcctttaagactccctccccagcccaggcaaaacatctcatctcataatccatagagaaaacagacattaaggaatagaaactcccttcccttcctgccaaaacactgacaagtctaccctgggcatccgcttttcctctccatcttccccccaagggttatgaattccatcttggggggctgaccctctcagctgtgtcctctttctgtatcatcttcatcctgtccttagctaatgaattctacctctgagaattcaagcgtcttctagtgtttcccatcttaaacacagtcagggctccccaggctacctaccaaggtgtgcactactgcaggtatacaagaccctagggcagaagggcttgcagttggggtttaatgtggttgctgtcttgaattgtaaggactttcgttttggatgtgtgttttgtaagtgaaggtcaatgggaaaatgaggcacacactggggactggggcctctgctctcacagggtcctgtcgcctcctaggagggtatctgggctgcccgctcccacagctcttgatacccctgctggtcctctcccactctgctccactgccactgctgaaagggatccaagcaaggtgtggggtttaagtatgcatacccacagcatcttgagtgcacaaaagccccaaacgggcagtgtcactttctgtctggtggctgcctggctggaggcaatctcttggtgagggtgagcctttggcccagcccggattccagatccagtcatggaggtttaaggatccttggtggttaccatctgctgtgggttggagcaataggcccgtggctcaaagtccccaaaccctgtccccagcagggcattcaggtcaggaggtttgcatgaatgtcatcacagcaagctatcaggcccagcacacattagtgggaccccagggccctctgaccgtctgtacttgctctgattacccacccctaatcctctagggccccagggccagagtgttctctgggctgtttccctgcctggggatgggatcctctccctccttccagccttcccgagtctggctgtgttcagtctcttctagccggcttgaggcatcctccagggacaagccacagaatataaactgtgtaatttcagtgactccacatgagttaaatattctgaaatttgcatttaaaactggtgttgcacaatataaacagtaaaattcatgctgataattcacatttttaattgttctttactctgaacatgaaatagtgcataaaaaacatgacaagtcaggatggaaaccctggaagaaaagaaaaagctttaggtgtacctttaatgacacttttttcctccctttgaaacaaagggcccctagattatagaggcagctctgagtccacctcttcctgcagatactgttctgtcagtttgtgacaagcttctcaagagtcgtctgccacaactaggtctttctgttgtgaatgcatgcccaggtcttttggcattcttccccctccccactttaatttcacaagtaatactggcatacagtccttctgtaaaagattcatgcaattgatatattttttaaagtccaacagaacaacatccactgcattcccattcctataattacccaggaataccatgatctaagcctaactagagagtgtatttctagatcactttctgtatatttatttacgtgatatgtatgtgtggagacagaggagagagagaatatatgaatataagaatgtatggttttgtgtgttttaaactaatgatagataatatttatattccataactttttaatgtaatatttcaccttggagattatatcaaataatgaaaatctgcttcatcattttaaaatggctgtttagtattccataatatgggtgcattatagtttatcaaactaagattatttctattataatgtcacaacaacaacaaaaaaatatatatatatctttttgtatacatgtataagtatttctctaggagagacatccaaaaaggaattattttctggattaaagaatatgcttacttaaaaaaaaatttcactgatactgccaaattgccgtctaagaaaaccagatcagcttattttgtttcctcctctccccccatatgaacacttgataatattaatcttttatagtttcacctatctggtagacaacaatggtatatcatttgcctattacatcacttacccattttgctctctcaggttatttcttttaatttgttaatgtgttctttggaactgaatgaattgagtcttttttttttttttttgaggtggagtcttgctctgttgcccaggctggagtccagtggcttgatctctgctcactgcaacctccacttcacgggttcaagagattctcctgcctcagcctcctcagtagctgggattacagaagcctaccacaatgcctggctaggttttttgtttgtttgtttgtttggtatttttagtagagacggggtttcaccatgttggccaggctggtctcgaactcctgaccttaagtgatccaccgccttggcctccctaagtgctgagattacaggcatgagccaccatgccgggccccaattctaagtcttggctcttggccggctctatgtgtgtgtgttaagtacaatttgtttcagaataagtttagctttacagaaaagttgcaaagatagtacagagagttcctgctgacttcccctaatattaatatcttgcataactatgggacatttgttgaaaactaaacgattaacgtgggtacagtataattaaattgcatcaagttctgcctgttttaactctttaatttctcttatatgcttccaattttgccaattcctcctactttccaaatgtgaaaactattttggacatgttactttcgagcctctggactttcataagcttaggtgtgcgagggtgcctggaggaggcagagagcataaatacaaagtcacatagagggtccacgtggagtttcacatttctgattcagttcaggaaacttttttcctcatgctcacctttatgaaagaactgctgtgagacatttctgagcctcaaacactaaggggagagtagaagaaatttacagctctttagattagtctgtcctcccaagatggcagggagtgccaaattcattgccttaaaaaaaagaaaaaaaaaaaaaaagatttcttaaaagcagcagaagactcccccagagtataatgtttgcatttttttacaatgtgtgtgttataaaacctttataataagtctttcaaaacaaataaatgtaaaatacagaaaaattagtagaacttgctaaaacactgcattttaaaaagaggtaagcatactttttattttaaaaatgttttaaaggacgataaatacacatctgtaaaaagaaacactggaaggaaaactaagaacaagtaataatggttacttttagaggagacagagggcagcaatgatatgagacttttctagatatgccctataaaccactttggctctggaaacaaaaattcttacattaaaaaaaaaatacaatgaaatttaaaaaaaaagccatctctaaaagctgaaaacaaattgaagaaagaaaattaatttacattaaatcagtgacctaactaaatagataaaagaattatttccaatgacactagcatattctaatgaaagtggcactgtaaaaaaatcttaaatttaattcagtagtcttttagtaataacactattactctgaaactgctctatatgtgtgtatgtgtacatcaactaaaactgttacatattcattagcatgtcatctaatatgtaattacacatgtcagaataatattatttatatgataaatgtataataattatatataatgtattgtctaatatatgatgtaatatatattagtacattttacgtctattagcaattaacacacatcaatttatatgaacattaccatactatgtatataatagttttgaagctacatataaatatataagaatttcaaagtaatattaacattattatatattagtgtataataatgctaatattacatattattacactaatatatattaatgtgtgttaatgttgttagaaaccaagattttctgtttaagagaaaagagaaacaagtataaaataaaaaaagttaagattttgcaattctagtttaagttgaaaaactcagcattaatttttttttaatataatgcctagctctggccattgaaaaggactgggagtaatggaaattcaatagcaaggagtactcctaatgtccgtattgtaatctccaactaggaacagctgattacaggtctggagcaagaaatatacaagataatattgggacattttgggccagaaagcaaggaagttctcaaagaataatgagtcaaaaggatacagaagccaacaacaagtagctcttattggccaaagatgatacaatttgatcctcaaaagaaaagaaacaaacaaaggaagaaaagaaaaagaatgcacctgactgaaaaaccctgaatatctaaaacccattaattcacaataacaaaaaagagcaggaaagcaagagagcccccaaaacaaacaataacctattgaacacccctggataaaacttgggaaccaagtccgtactctgtaagctgtcaattaaaagaggagaaagaggagaatatattttgtatgaactttatttcagatagccaaataactctaattgctgagggaaagtttttcttaataaatctggaaggaattatagaaaatcatcatcctgtactacttaatgaaataatagattcaggcagtgatcatcaaaggatcaaatgatcaatcttagcatcactgaaggcaagacaagcaaacatttatgcctcccatgtgaggcaattggaagcacacagtagtatctatgaaggattcctgccaaaaagtgaaacctgaatgaaatccagtctacagggctaatgtgcataaacagaaatacaagggaaggaggtacaagttaaatgactccaaaggcaagctttacagacggatgtgggagggcctatataggaaaagagaccccattttaaaaacaagttaataaaaaagaaaaggaaaatgggactgctgtggattttatgtggatttcttttcaaatctactcactgtaaaacgacattttaaagacaactagagaaatttgattatggactgagtgttagatgggacctagatgtgacaatggcatcatgactacataaggaagggacccctttttaggagatacatgttgaaatatttacagttgaaatgacatgtttgggatttgcttttaaatacttcagcaaagagaaaaataaaaaatagaggcagcaaatgcggcaaaatattcaaaattggtgaatcaggcgatgagcacatggagggtttattgtattattcatctttctttggagtatgtttaaatgttggtgtacatttgacagttctttatcacgcaaatcaacaataacataaaaactgaaatatttctgtcagctaaaataggtagactgtaaataattgccatacattattcctgtccctgtttggatgtgccactgtggctcttctcatcaacagatggagtcttttcttccatcccttgaatctggtcagcagtgagaactgctttagttaaagggtaaacatgacacaagcagaggcttgaaaagcactagggcattggggcggctgagagccctgggcctaccacaggagaagttcagactagcttgctggagaggtcatgtggaaaagaaatgagaccctggctgagggtctgccaacctgtagacatatgagtgagggaattgtagaccacacagccccagccaagccacaaactgactgcatctgcagagtcagcccaggcaagtctagctgtctgagccagatttgccgacgcacagaatcatgattgttttttaatatgctaaatactgaggtggtttgttacatggcaatgactgactgatacataaggataaacctatagaagtactatacacatatgcagaaaactgtcttagcttcttagcactgtgagggacatgccatgtactcaataaggatgtctgaatgggaattccatgtcactagaaaatggtatatatggaaactgtctaaaggcaatggaaggcttaggtagactacttccttttgtgtatatgaagtactatcaaaccaagtagttactccactgatagaggcagatgtgggaagataaactatgtagaactttttttccttggaagactaaaaaggtctggctttgccgctggtcaactatgaccagacactacggaaacagtcattgagattgctggcagatggcctggcctttctcccctgacacaattctgcaacccaagtggccagtgtgtggagagaacacacatccctgtgagaggccgcctagcttttcctcccctaagggccacactgggccaccccagcacacatcaacttggctggcacactttcctgcaaagcagattccactctgtgtactctgagaacaaatcatgtttcctccttgccaaaggtttttgcttgcaaatgttggatccaggtataaggattaatgagggaatatttagagtgccacaaaaaaaaagttctatatagaagccacagaagtacatgtggatcttctagtagaggtattttttactaaaagaaaataccaaaacattttcatcttaaaaagctcaagtaaatctgatcaatttagcagaatcacataatttgtaataatatacgtataaggattgtgtagttaatcttagtatcattagcaaaatactatacttgtaaaagaaaaattcaagatagttaaatatttctccataatagtagctatttaattggaaaattttttgttttctttgagacagtctcgctctgtcacccaggctggagtgcagtggcatagtctcagctcactgcaacctctgcctcccgggttcaagcaattctcatgtctcagcctcccgagtagctgaaattacaggtgcacaccaccacatcctgctaatgtttgtatttttagtagagatgggatttggccatgttgggaggctaatcttgaactcctgacctcaagtgacctgcctgctctaacctcccaaaattgctaggattacaggtgtgaaccaccacacccggcctacttggaaagtatttttaaattaattgatactttaatctttgatgaatatagctattctcagtatattaaaatgactactcacacaacgccacccacatttacatgctaatttatccaacctcctcatttatatttttaaagatgcaatataatttttgtaagtatatatatatatatatatatatattttttttttttttttttttgagacggagtcttgctctgtccccaggctggagtgcagtggcgcaatctcggctcactgcaagctccacctcccgggttcacgccattctcctgcctcagcctcctgagtagctgggatacaggcgcccgccaccacgcccggctaattttttgtatttttagtagagacagggtttcaccatgttagccacgatggtctcaatctcctgacctcgtgatcggcccacctcggcttcccaatgtgctgggattacaggcatgagccactgggcccggccgtaagtatattttttaaagcttaagaatcttgtgagtaaatagggattttttttttttttgagacaaagtctcactcttttgccaggctggagtgcagtggcgagatctcggctcactgcatcctccacctcccaggttcaagcaattctctgcctcagcctccagagtagctgggattacaggcgggcaccacccgcccagctaatttttgtgtttttggtagagacagagtttcaccatcgtggccaggctgttcttgaactcctgacctcacaatccacctgccttggcctcccagagtgctgggattacaggcatgagccaccgcacagccggcctgagatgttttatactattttgcagtagcaaacttctatccagtaaatgtttcaagtatctttttgaaccatgactttggagttaacattattcaatgaggttaatgacacaaaaagataattaaatatggtgaacggaaagaatggacagtaaaagctaagaaaaattggtggcagcttcattatttgtgaaactaaacttgaaggggacaaattaaaacttgcagctgagcttcaagtgcagcaaaaaccggcagaaaccagggtccccacagggattctgcgctttggggagaacttctgttcttctgctcctgttttgtcctgttttgtctttctgaaaaggcaacacaaagagctgaggaaaagccaatagattcattatcattctacctaataataaaataatgttctcttaacaaagtgtggacacacatggcgaaggcatcagaaagaacctgatggaaataatctggaaaaggtcttttgggaatgaagtttcctcatctgcagaatggaggaggggtaatgagaggggcttgttgggggccaggagaagtgggctggatgaattccaagatcctttatagctataactttcagtgatctaggttaaaagctgaagatctttttcatccctgactatgaggccaatgtgagatgtggttatctgtaggtcttacagtgcttattataaaactatatattaatactttgtttccatgaaaagctctaattttaaatgtgggtaattttaaatgtgattaatatttccataacggagtgcatattatatgaaaatcaaaagttttataaaagctgggcacatttaaaaacatacaaaatcccagctcagcttaagtatatggttgcaagagtgtgtgttttcaaagggtggggcttcctgtctctggattgtttggaaacattctgacaaagccaaattcatttcactgatatcctgaatgcagcaaggaactggtgcctaaaatagcacaaaattgcctgtagtcccagctactggcgaggctgaggtgggaggatcacctgaccccaggaggttgaggctgcagtgagctatgatcgcgccactgcactccagcctaggccacagggcgagaccctagctgcaaaaaaaaaacaaaaagcacaaaacatgatactctaacatgtagaatcagtttaagtcaactaagaaatgtgataaacacccaaaagatttcaaatctgtattctctaaatccttttgagagagtctccacaattagctggactggaaaacttagcaacatttagcatacttttcggtcacatattcattcattctttttttaactattcaacaaataggtaaatagatggacggggaaagagagagagagagagacagagagagacagagagagagagaggagatagatacctcttactacatgccagaaacaatttcttttaaaatttttccagtttttttcttctttaacttcatactccctttgtctcctgtctttgttgggtatgattattcaagaatacatttaacttgtggcactaaatccagagcactctctaatagggagaaaacacaaccactgtggtgtcaggaggaggaagtaaatgtgtgagcagcttggtacactcttcactatcctcacctcaaaggaaatacagaggtggatcaggaagccagtttcaactggacttactgctgcttcttgctgacactattgttacgttatctgtgggatgatcaactttttttttttttttgagagacagagtcttgctctgtcgccaggctggagtgcagttgcacaatctcagctcactgcaagctccgcctcccgggttcacgccattcacctgcctcagcctcccgagtagctgggactacaggcacccgccaccacgcctggctaattttttgtattttagtagagacggggtttcaccgtgttggccaggatggtctccatctcctgacctcgtgaaccacctgcctcagcctcccaagtactgagattacaggcctgagccactgcgcccagccgggatgatcaacttttaaagagtcaacctgggacacagtgataatgacaaaaaccataacaacataacattgctatggtctgaatatccccccaaattcatgagttgaaacttaatcaccaatgtcatagtattatgaagtggggccttcagaggcaactaagtcatggagacagagccctcatgaatgagattactgacctgataaaagggctggagggagagagatcacccctttttacccatccatcatttttctgcctctgtcatgtaagaaaacagtcttcctcccctctagaggatacagccacaaagtgccaacttggaagcagagagcagccctcaaagacaccaaacccactggcgcagcccccttggaccttgcagcttccaaaacagtgagaaataaatttatactgtccataaattacccaatctatgatattttgctatagcaacacaaatggactaagacaaacataaaagaagtaattacacatgtgttactgctttaacacagaaaagatgtggaggtgaaatatattattctgtattatttacttttctgtaacataaatgttattatttaaacagaacaacaatagaactagttaatgatagtaattaatagtagaacaaattaagcaatgtgtgagaaaaatataacaatacttttaaatgtttctttctgttctctgatacaggagtttattttaactatttttttaaaaagtcttcctagcactttggtaggctgatgcgggtggatcacctgaggtcgggacttcaagaccagcctgaccaacatggagaaaccccatctctactaaaaatacaaaattagctgggagtggcagtgggtgcctgtaatcctagctactcaggaggctgaggcaggagaatcacttgaacccgggaggcggaggttgtggtgagccaagatggcgcccttgcactccagcctaggcaacaaaagagaaactccgtctcaaaaaaaattaaaaacaaaaagtctctatttgttatttaaattttgtaggctttatatgttgtgtattcttaacacatataaatgtacgacttttacaaagaaaacataaatacaacatggctaatttaaaagatagtacctatatttagtaacaacagcaaaagatcatgtcctgtttctttctgccccatgacacagtgggatatctttactctttctgtttccttttccaataacacttctttgaactgcctgcagtggtaagacatatctcttttgacttgcacctctgctcttctcaagcgcacaatacactgattcctggtatcaatccaatgtgatgacatcaagctaaatatcctctcaaaagcatctgagtgtggaatacctataattttatttcctagcaagaataggattttagacttaggaggattcatttccagctctccaaaaatgtccatccctttgttaattaggttgttagcatctataaattcatcacataggctacacatatataaaatatccactgttctataaaaccttttattttgaaacaatcgtagattaacaagaagttggccaggcatggtagctcacgcctgtaatcccagcattttgggaggctgaggcaggtggatcactggaggccatgagttcaagactagtctggccaatatggcaaaaccctgtctctactaaaaatacaaaaattagccaggtgtggtggtgcacatctataattccagctacttgggaggctgaggcataagaattgcttgaacccaggaggcagaggttgcagtgagctgagattgcaccaccgcactccagcctgggtgatggagtaagactgtgtctcaaaaaagaaaataaaacaagaagttgcaaagaaatgtacagggtagtacaagctacccacacccagcccctccaatgtgaagaataccttacataactctagaacaatattcaaaccaagaaattgacattggtacattccaaacatgttattcagatttcacctgttatacatgtactctgtgtgtctgtgtgtgtgtgtgtgtgtgtgtagtgtgcacagctctctgcaactttatcacaatgtagtctttcttgtataaccataaccaccaccaccactgagggatttaactatgccttcaccacaagactctctcatgttactccttacagcctacacccatcctctctccccagtccctaacccctggcaactactaacctgttctccctctctataattatgttacttcatgaacattacataaatggaaccatacagtacgtaacctgctggaattatgtttgttcatcaccgtaacttccttgaggtttatacaagttgttgcatgtatcaatggttccttcctttttatcagaatagtaatccacagtaaaaattcaccttttttttttttttttttttttttgagacggagtctggctctgtcacccaggctggagtgcagtggtgccatctcggctcactgcaagctccgcctcccgggttcacgccattctcctgcctcagcctcccgagtagctgggactacaggagcccaccaccatgcccggctaatcttttgtatttttactagagacgaggtttccctgtgttagccaggatggtcttgatttcctgacctcgtgatctgcccgcctcagccttccaaagtgctgggattacaggtgtgagccaccgcacccggcctaaattcacctattgaaggacatttgagtggtttccaaatttcttgctattataaaaatagtggctgggtacagtagctcatgcctgtaatcccaacactttaagatgccaaggtaagaggatcacttgagcccaggaattcaagactagcctgggcaacatagtgagacctcatctctacatttaacagtttaaaaattagcagggtgtggtggtgtgcacctgtagtcccagctactcaggaggctgaggtgggaggattgagcctaggaggtagaggctacagtgagctatgactgtgacactttactccatctttggtgacagagagagaacttgtctctaaaaatataaataataaaataacaagaaaaatattatacgaaaaccgtgaaactgttatgaacattcctgtacaaatccccatgtgaaaataactcttcatttctctggaataaatgcctaagaattgaaatgataagttgtatggtaaattcatttttagttttgaaaggaactaccaaattgttttccagtgtggctgtctcattttatattcctaccaccaatgtaggagtgatccagtttctttgcatccttgccaacatatgatgttttcactattttttcactctagccattctgatttgtgtgtaatgataccttgtggttttattaagaatttgcatttcttcaaaagctaatgacattgaacagcttttcatgggcttacttgccacctgcatgtccccttgatgaggtgtgtgtgtcttttgtccagtttctaatcagatttttttaaactattgagttttgagaggtctttatatatttatgtgcaaggactttgttgaatatgcgatttgcgaatgcagtattttctctcatctagtttgttttttcatcctttcagcagactctttcccagagcaaaggttgattctgatgtgttctaattgatcagtttttcctcttatggattgtttttggcatcaagtctaacaggtcttcacccagtcctaagtcctctctcttatgaattttctagaagttttatagtttcacatgtaagtttgtccatcatttttaaacactctgaagagatgttattaagttaaacgtctctttctcaggttgggcaagagggaagaaatgtaggtgaggatagacgaaggggcgataagaaagggtgacggaagacaggctcggcagactttcccgtgagagaaatgctccagacagcaccctgttcctccaggagctgaatcttgggcatggattctccctaccccatccccgcccatcctgcccacaacactgccccaggacacgcctcctgaggccaggcagcctccatctttatgtggccaaagggggtctaggtagttgtcagcttcagcttctggaaagagaccagctgctgtatccagtgggtcccagtggtttgcttagataggatgccactcactatgccaggtgtttgggatagaagaaagaataactggaaggtctcagtattcaaagaacctacagtccagagaaggacacaaaataagaaagaagagagcaagggctaagggtacaggtaggagagagaagcagaaaaggggagcataactgagacttcgggaaggctttcctaggagatagcactgtagatgtgtggctatctgaaattgcaaactgtgaaccagagaataagagttcctgcatttcaaagtccttgaagtagatttcaaagggtaccagtttgagggctgctcttctaaaaataggacactggcatttcccatgagcaacaagaactcacaagaaggtggaatgtgactggataaggctgacaacaaggggaagcaagcctgacattctccccaccagcctggaagtctgggccttagcaaatgtgaaaggctagggttcaagctgaaaccccgtgtccttatgtaacctagacgaggctgcagtttagttgggctaggctacggccaaaagcttaccaagcagaaattcagggggaaaatatttcagcaaaaatatttaacccactgaaaataatttatacttgttcatatgtttacaaacaacctgctgattaaaatggctcttaactactcattaaaaggaggcccacccttcaggacctatactttgcaacacttagttactatttaattggagatacagtataagcaaaaatatgaaaaggctgcatttctttatatgctataattttactttgtgatgattctaactttctctgccctcaattagtctgatttagtgatgtcttgtcatgtataggctataaaatcctgatgctgtttctcaacttgccagtcagaatagcaggattaataaattctcaagatttttaaaagatcaaaattggagcccctgtttttttccttccttcctcctcctccctccctcccctcctttttccttcctttcttccctgatttttagtaacatttatcataaaaaatacaacctatatatttcttgaccataacttacatgtgattgagaagcatcgaattagagtttgtggtctctgtcttccaatatcttgtatgtactatacataataaagttggttcatcatcataactggggctttttaaagccagaaccccatcaagaattcccataagtaggaacatttccagaagtggtagggtacagtaagattttttgatctgctggtaaacgctgacggggatacccacttaggctattttattttgaaagagcgatgaaaatttgagcaaatgatagcttccagatacagtaagtcctcacttaacatcattgatagagtcttagaaactgccactttaagtgaaacgacgtataacaaaagcagttgtatcataggttcattgatataaacaagagttaagttcctggagcgtatttctggccatgaaaacatcaccaaacttctaaataaaagccccaaacgcttctaactattaagcattgaaataaatgtgagctatacatacatttaagaaagattaataagaacaagtaagatagctatttactcaattcttccattatcaggaataattaattgagtctgccagatcgtgtcccaacagctcagggtgcaaggagggaaccaaccctggacagtatgccatcccccaccgcaggtgcacccacacacacccacactcacactgggaccaagcagacaccatggttcacctcacatgcacggctttgcaatgtgggaggaaaccagagtacctgcagaaacctacagagacatggggagaccatgcaaactccacacagacagtggccccgcgccaggaattgctttctagtcaatgttgtaagaaaatgacattgaatgaaatgatgttattcaagaacctgctgtaaaggaaggccaatatatgatcagaagtgcacatctctaatgaagaaatcaggaagagccattttgctttcccttaaccctgctgcccccaggtaacaatagtaagtttccttcagttacccctttcttttccacatagaagaaggaaatttcacttttgaaatgttgaattatcctgttttcacgcaagcaaagttgcataatggtcttggctttgccagctacatggtgtctacaggtggacaaaatgcctatttctgtgtccttaccaataaaaatgggataatcactgatttttttaaaaagtcattgctataaagattaaaacgaactcctgtatgagaaagtaaataaaaccactaaaaaatatgagtaaaaatgctcattttgtaaccaaatgattctttatgtcccttttattttgtcctgctatttgctattgattgctgttcctatctttgacttttctttctgttttttttcttttttcttttctttttttttttctttttttgagacggagtttcgctcttgttgcccaggctggagtgcaatggcgcaatctcggctcactgcaacatccgcctcccgggttcaagcgattttcctgactcagcctcctgagttagctgggattacaggtgcccaccaccacacctggctaattttgtatttgtagtagagacggggtttctctatgttggtcaggctggtctcgaactcccaacctcaggtgatccgccagcctcagcctcccaaaatgctgggattacaggcgtgagccaccgtgcccagcctacctttgatttttctatcaatgcaaagttggaggagttaagcaaccattcctaagatgaagaaagttatcttctagaccaaattcaattttcagcagtaaggaacagacaaaaaatcctcttcccctgccccacagcttccattgtactagaaaaacacagacaacaaataaaacaaataagaaaaatatgtgaaatgttcaatggtagtaagtgctagagaggaaaaactaagtgaagaaagtgaaggaggaggatagggcatctgtggggaaggcaggggacggctcaatctatggattcaggaagggtgtggtctgcgtgctcccagtgtgagtgtgggtgtgtgggctggaagaggccagggagtgagtcacatgtacatccaggaaaatgcttccaggcagaagggacagtaaccacaaggtgggagaggccttgatgtatctgaggacagctggagatcagtgggctgaagcagagtgagaattgaaggggaggagagcaaagaagcagcagagctgggctagggtgggcagagcaccagagtgactgtttttttgtgtgttgttttgaaacagagtcttgctctgtcgcccaggctggagccttgagacggagtctccctctgtctcccaggctgcagtgcgcggctcactgcaacctcctcatctcgggttgaagcgcttctcctgcctcagcctcccgagtagctgggactacaggcatgcatcaccacgccggcggatttttgtattttagtagagacagggtttcatcatgttggccaggctgatctcgaacacctgacctcaagtgatctaccctcctcagcctcccaaagttctgggattacaggcatgagccactgcacccggcccacagtggctgttctaacagaaacgctgctgctgtgcagagaaggaaggcaagagcaagggtggacacaggccagtgaggtggcaccagcagtgacccagggatgaggtcatagcagcctggaccagacagcatcagtggatgtgctgctggactccagacacatggtgaaggcagagctgacaagatgcgagggtagactggatgcatggtatggagaaagcggggagtcaagattttttatctgagcaactagaaggacagcacagccatctagtaagatggtaaagacttctggaaaagcaggttttggaggctgatgtcaggagcaagtttggggcacgttatatgtgagtcatgtattacatatccacctagaaatgttgagtaggcaattggtgagatcaatctggacttaaggagaaatattcaggttggaggtacaaataatcatcaatttaagatgctatttgaagccatgaggaggggctagctcacaaagcagggtgcagataccaagaagagatccaagaccaggctttgggcatgccaatggtaagaggtttgggagaagtggcaatggtgactaagtttgagtggacagtaagacagagtatggcatcttggaagccaactgcagaacatgtttgaaaaaggaactgattgaccgtgacctgtgtcaaatgctattgttaggctaagaagatgataacagaaaaatgaccaaaatggatactcccaagccctcaaacaaagtatgctaaagcagtttttaatgttttaataaggtcttaagtttaagatgagaatttgcacaaatatttatatcctctcctaaatctcactaaaatgaccctaaaaataagaaaggataaagacaatattggtcaggctatgtctcttcctctctcttccctaaactctaaacagatgctgggattaattcaaagatggattttccagcttaaactgactattcatcccaggaaatccagaggaatggaagccccagagatacaaaaggaaatacgaaacctcccaggactccagcaggtttgtgaggagataacaatataggtggagtgacaagaagacacacataaaaagtcaagcaaaataaagaagacaaatgtcaatttacaaaataaattgtactggctgggcgcagaggatcacacctgtaatcccagcactttgggaggcagaggcgggcagatcacgagggcaagagatcgagaccatctggccaacatggtgaaaccccatctctactgaaaaaaaacaaaaattagccgggcgtggtggcaggcgcctgtagccccagctgtcgggaggctgaggcaggagaatggcgtgaaaccgggaggcggagcttatagtgagctgatatagcgccactgcactccagcctggtgacagggcgagactccatctcaataaataaataaaattaaattaaaaagttgtactaataatctaacatagttttcactattctattacaaggcagcagagagtgctggctcaccagtggccagggggaggtcaacattcacatggattaccatgagcttctcaattcccagtcttatctccattccctctcagctacacatatgcatgggcacacaagggacttctccatcatcccaaactgcctcctcccccaactcactgcactcacacctcctaaccacacacacttaactcctatctttgcgtctttcttctcttgcctcctgacccctccaatgcattctctacactgcactcaactgatctttaagagacccatcaccataacctctcctgcttataatcctgcaaaactgaagcccacatccttaatatggcctacagctcctgcagatcagaccttcctcccaggcttgtccaatgtctttccattcactgcgatagccccagtgagggtccccccagttctaggatggcaccatgctccttcccagctcaggccctgcacctatgctgcgcctttcattgccttctccaccagtgcctgacatggcacattagaaagctttcggttaataactacttctctattcacttgctgatttgatatcagggagttacacacaagagaagggagacctggataaaagggggaaatgacaagcagagagagcaaaatgatcagtttattcactcattctagacatattgaagaggttagggaggtccaggtaaattggagcagtggaaatcttaaagagccaggggtcaacatatcagccctacaaaagaaaacaaggggcctgatgcggtggctcacgtctgtaatcccagcactttgggaggccgaggcgggcggatcacgaggtcaggagatcgagaccatcctggctgacatggtgcaaccccatctctactaaaaatacaaaaaagttagccgggcctggtggcgggtgcctgtagtcccagctactcaggaggctgcggcaggagaatggtgtgaacctgggaggtggagcttgcagtgagccgagatggtgccactgcactccagcctgggcaacaaagcgggactccgtctcaaagaaaaaaaagaaagaaagaaagaaaacaagggctgagatcaaggaaaatggtctgaatacatatcaatgcctgattcaagtaatgtttggaagaaatcagtaaatatttattgaacacttactatatgcaaagcaacatagtacaaaacgatacatagtttacttttgtttacttgtttatttaatttttttgagacggggtcttgctctgtcacccaggctggagtacagtggcatgatcacggctcactgcagcctcaaactcctgggctcaagcaatcttttcctctcagcttccagagtagctgggaccacaggtgcgcaccaccacacccagctaatttttgtatttttttgtagagacgagttttgcatgatgcccagccaagaaccagccttttgattttttgcttttttcttttgttttcctatttttaattctattaatttctgctctttattattcccttcttttgcttgctttggctgattttgctctcctttttctaggttcttgaggtagtaaattaggttactgatttgatgccactctacacttttaaagtaagcacttgggctgggcccagtggctcacgcctgtaatcccagcactttgcgaggctgaggtgggcggatcacgaggtcaggagattgaaaccatcctagctaacaaggtgaaatctcatctctactaaaaatacaaaaaattagccgggcgaggtggtgcgtgcctgtagtcccagctgctcgggaggctgaggtaggagaatggtgtgaacccgggaggcggaggttgcagtgagcagagatcgcgctactgcactccagcctgggtgacagagctagactctgtctcaaaaaaataaaaataaaaataacataaataaaaaatagagtaagcggttagtgctattcatttccctctgattcactgctatggctgcatcccacatattttgaatatgttttcaacatatgtttttatttccaattatgtgtatttttacattttctttgagaaaactttctctttgacccattgattatttagaagtgttgttttatttccacgtttaaagctttttcctgttgtgtttctgttactgtttcctagtttgatttcattgtggcagagaacatactcacatgattacagttattttaaatttcctgaggcatgttttatgacccaagatatgatcaaatatggtctttcttggtgaatgttccatgagtgcttgaaaaaaaaaaagtttctgctgagggttgggttactgttctgcagatgttaatcagatcctcttagattgtgttgttcagatcttctttccccttgctgatttactatttagtatttctcagttgctgagagggtgctgtgatcctcaactataattgtgggcttgtctaggtctctttacagctttatcaatttttgttttgtgcatttttgaggctatggtgtttggtgcatatgaacatttatattttaagtatcagttatattaagcatatcttaaaatgctgaaaactctatttctagatattatctatgtagacagcctgatacattttatagtagtaacagaggaagttgactagagacaaatttaaaaataaaactttcagtatagataatgcagaaactattggctgggcatggtggctcacgcctgtaattccagcactttgggaagccaaggcgagcggatcacaaggtcaagagattgagaccatctggccaacatggtgaaaccccatctctactaaaaatacaaaaattagctgggcatggtggcatgtgcctgtagtcccagctacttgggaggctgaggcaggagaatcatttgaaccagggaggcggaggttgcagtgagccgagatcacaccactgaacaccagcctggcgacagagtgagactccatctcaaaataaaaaaaaaaagaaactattatcccaacatattattttctgtggttttttttaaatatatggagaactgatggtgctacgtttttataaaatactctttttcacataagataaatagaatatataataacttgctgacatatcatcagtaaagacttctaaatgataatgtaacatctctgaaacatatcttataaacaagagaaaaaaagagtagaaccaaaatgaaactttaaatttaattacattaaaattaatgttttgagtaggttttgttgaataactagtaggcttgacccttggctaaaaaataattttcttcacgaaatctacatacagcacttctacctttcttatatttgccacatttcattttgtgttatagttacatgtatgtttgttttaatagtattactacattgtttgtacacagccacatgtatggtatgctggttttaaaacatatatttacaaagtcttagatactcagcaagtggagtttattccactcaccccgcaccccccactgttttaatgtgggcttagtgactcacttctttttaaaaacaaattttatttaaaaaaaaaaaaaaaagaccaggcatggtgactcatacctgtaatcccaacattttgggaggctgaggtgggatgatcacctgaggtcagcaatttgataccagccttaccaatatgacaaaatgctctctactaaaaatacaaaaaaattagctgggcatagtggcatgtgcctgtaatcctagctactcaggaggctgaggcaggagaattgcttgaacccgggagtcggaggttcggaggttgcaatgagctgagatcgtgccactgtactccagcctgggcaacagagaggactccgtctcaaaaaaaaaaaaaaaagagacaaggtctcatattgtccaggctggtcttgaattcctgggcttaagtgatccacctacctcggtcttccaaagtgctgggattgtagacgcgaaccaccacgcctggccattagtgactcacttctaacaaacagaataaggcagaagtgatggcgtgtcctgcagatttggtcatgcatggccctgtgggttccttgttctctcttggatcactcgctctggggaaagccagatgctctgtcatgagggcattcaagcagcaccctggagtggtctatgtggggaagaactgaggcctcctgccagcagccatgtgctggagttaacctgagagcagatcctctagccttggatggaccctggatctaaacctcacaccttatacaaaaattaactcaaaaacgtatgacacttaagtataggtgcctgtagttctggctgacgtcttgactgcaacttcacaagaagtgctgaaccagaaccccctcaactaagctgcttctagagtcctatttattgtgaggaatattattttagagactttgtgaaataataaatgtttatttttgtttgtttttgtttgatacggagtctcactctgtagcccaggctggagtgtagtggcgcaatctcggctcactgcaagctccgcctcccaggtcctggtttaagcaattctcctgcctcagccacccaagtagctgggattacaggcacacgccaccatgcccagctaatttttgtatttttagtagagacagggtttcatcatgttggccaggctggtcttgaactcctgacctcgtgatccgcccaccttggcctcccaaagtgctgggattacaggcatgagccaccgcgcccagccaaatgtttattgttttaagccaccaacttttgttatatagcaataaataaataaataatgaaataggctgggcacagtggctcacacctgcaatcccagcactttgggaggctgaggtgggcagattgtttgagcccaggaggtagagaccagcccggggggtaacagagcaaaaccctgtctctatgagaaaaaacaaataagtaataaaataaaatataggctgggcacagtggctcacgcctgtaatcctagcactttgggaggccgaggtaggtgaatcacttgaggccagtagtttgagatcagcctggccaatatggtgaaacgctgtctctactaaaaatacaaaaattagctgggcatcctggcatgtgcccgtaattccagatacttgggaggctgaggcaggaaaatcacttgaatccaggcggcagaggttgcagtgagccaagactgtgccactgcattccagcctgggcaacagagtgagactctgcctcaaaaaatacatataaaataaaaattttaaaaataaaataaattatagaaaagaccagctctttagggaaaaaacaataaaattgataaacctctagcaagactgacagaaacaaaaagcaaggaaacataaaaaatattaagactaaaataagggatatcactacagaccctacagtcgttattagtataataaccaaatactataggcaattttatactctgaaatttgataactcagaagaaatgggcaaatacctcaaaaaccacaaatagccaacacggatgaaacaggcaatctgaatagccctattaccaatttaaaaaaccaatatctaatttaaaaactcccaaaagataagtttccagggccagatggtttcactagagaattctaccaaacatttaaagaagaacaacgccaataaaaatccttgcaagatatttgtagatatagacaagactattctaaagcttatatggaaaggaaaagaaattagattagctaaaacaattttgaaaaaaataaaatggaagaaatcagtcttctggatttcaggacttattatatagctatgattaagactatgtagtattggcaaagggatacatataaagatcagtggaacccagaaataatcctatgcaaatatgcctgggagccaggcatggtggcatctgccttctacctatatcatatatgtccaactcttttttcataaaggtgcaacagcaattcagtagaaggatagccttttggataaatggtgctacagcacctggacaatcacaggcaaaaaaaaatgaccctggatctaaacctcatgccttatatgaaagttaactcaaaatgtatgacacttaagtattataaaattataaaacttttaaggtaaaaaatgagaaaatctttgagctctcaagctaggcaaaaatttcttagacctgacactaaaaggacagttcccaaaaggaaatattgataaactggacatcatcaaaattaaaaattttttgttctgctaaagagctgtgatgaggatgaaaagacaagctacagaatgaaagaaaatatttgtaaaccacatatctgacaaaggactagaatatacaatgaagtcttaaaattcaactgtaaaaaaacaaacagcccaagtaaaaaatgaacaaaagacagacatttcattgaacaggatattccgatggctaatggaccacaaaaagacattcaacatcattattcctcagagaaacgccaattaaaaccacaatgagacatcactgcatacctgtcagtgtcatacctatttggtgacagcaccaagtgtggagaggatgtgaaaaaattggatcacttgtacattgctgggaatgtgatatagtacagccactctggaaaacagtttagcagtttcttaaaatccaaaacacgcaattaccatacccagcaattgcactcttaggcatttatcccagcaaaataaaaacttagggccgggcatggtggctcacgcctgtaatcccacactttgggaggccgaggtgggcggatcacctgaggttaggagtttgagaccagcctcaaaatggagaaaccccgtctctactaaaaatacaaaattagccaggcatgtggtgcatgcctgtagtcccagctactcgggaggctgaggcaggagaattgcttgaacctgggaggcggaggttgcagtgagccgagatcatgccattgcattccagcctgggcaaccacagcgaaacttcatctcaaaaaaaaaaaacaaaaaaacttaggttcacacaaaaacctgtacacaaatattcatagcagcttaattataatatccccaaactggaatcagcccagatgttcttcaataagtgaatggttaaactgtggtattcaccccatggaatattactcaataataaaaagaacaaactattgatacatgcaacaacttggatgtatctctaggaaattatgttgagtaaaataagccaatcccaaaagtttcattctgttttgggttttaaattccatttatagaacattttaaagtgataacattttaaaaatggaggatagatcagttcttccagcatctggggaccagtagaggggctggaggaacatgtgtgtgattataacaaggcaacatgagagagtctcctggtgttggaaacgttccatatctcaatccgatagtagatacgtgaaccaatgcaggtgatactgtacagaacttaatatgcacaaattcaaataaaactggggacatctgaataagatcagtggattaacatcaatgctaatatcctggttatccttctataaaatattaccatttggggacattggacaaagtatacaaggcacttctctgtaacaattctcataactgcatgtgaaactataaataaaaaatattaaagatgatgtgaacagagatacacacttttaggtggctgtatttttccccccacaggagtcatacttaacacaatggccaagctataaaaattgaatgagaggaactgatgtcctagggttacttatcaacatatctaaagtaaaataaatacaagcatagtttttaaaatttcaaagctctataaaatgcaattttacaaggttactaaatgtgcttgttttcaggatcctgaaggcaatttcctggtatcaaaacccacatatcctttattgagaatgacttgcacaacactattctgcattacatgggaataaaatgatgggtggttttttccgagagaacatatccaggagcaacgacgcacctgcagttggagcagatagtcgctatactttcaccgcatcaccactagatttccatgaattctgcatgagaaaactgtgactgatatgtcagttttttcacttagtttatagtacacgcaaaaataacatggccagtctcttgccatgttatttccaaagaaaattacttggaaaatatacctttcaccaaactctaaatccatgtgcaaaatgtaatattttatacaccatataaaaataccaaaaaacatctagcagtaccaaatcaagatgagacacaagagagggatcctatgcactggtagctgcaggatggcttctgtagtaagttgtatggtgtggtctccaataagatatgtcctaatcccagaacctaggaaggtgaccttattggaaaaaagggtctctatagatgtaagttaaggatttggggctgaagagatcattccagattatccagatgggccctatgtccaatgataaatgtccttataagagggaggcagaggaagattggtccgagacaaaagaggggaacgtgatgtgaagagggagggaaagattagagagatatgaccacacgtccaggaatgccagggcatcaccagaagctgggagagacaaggaacacattctcccctggctctccctcagggcgtgtgaccctgccagattttggagttccagccttcaaaactgtgagtaaaactatttctattgctaaagtcaccaagtgtgtggtgatttaggatggcagccacaggaacagtttgactcccttcacccggagtacaatccacgcacctgccaatcaaagcaacaaagtatgaaaatcactactttaaaaactcaagacaaaagaaacctcaaaaatactagcttatgtaaccatgagaccttcaaactggccttgaattcagaataaacaagaaacagccaaatagaaagctatcattgaggaggggaaaaaaaaaggttagaaacaactaacttttaattctgttcaaagagaagcagtactaccaagatatcaaataaataattcctttaattaataagcaatctgcaaagaatgagcataaaattgtgaatatgagttaatttgatacttccactgtataccagaaacactactttaaaatataatggaaaaaacactcctttcacaaaagtaatgaaaaatatgaaacatagtttcaagaagtaactttaaccaaccttgcatggacctatatgaaaaaaaaataaacagcttttattaatcattgtttatatcttcaagaacacttgaacaagtgggacctgcttggttgttgggtagaagattgagtaactgtaaggtacaagttagtctcaagatgctgacaagtttgacacatgcaaaaaaagtcccaaatatattttttgagtgaagttaatcaaataactccaaagcacaactggtatgaaaatctagtgagatcacaacacaaacaatagataaatgtttgaagttatagatatcccaattaccctgatatgatcatgacacattgtatacatgtatcaaaatagcacgtgtagctccaaaatatgtcaactattccatatcataattaaaaaaataaagtgagaaagaaaagatttattaacacttatagccaggtgtggtggctcacacctgtaatcccagcactttgggaggccaaggcaggtggatcacttgaggtcaggagttcaagaccagcctggccaacatggtgaaaccccgtctctactaaaaatacaaaaactagctgggcctggtggcacgcgcctgtaatcccagttactcaggaggctgaggcacgagaatcgcttgaactcaggagatggaggcttcagtgagccgagataacaacactgcactccagcctgggtgacaaagcaaaactccatctcaaagaaaaaaaaaaaagacttataaagtaaactaatgggcatagtgatgacacggtctgctaaatattaaaacaggacataaaggtacacttattaaaacgtaaggaacaacatacagctgcacgaagcatatgtccatataggaacttgtatgcaaacattcacagcagcattatttcataagagccaaaaagcaaaaacagcacaactgtgcttcagctgatgaacagataaataagatgtggcatatccatacaatagaatattattcagtcataaaaatgaatgtagccaggagaggtggcatgcacctgtagtcttagctactcaagaggctgaggagggaggatcacttgagcaccgggcaacatagtgagaccctgtcactttaaaaaaaaatgaggctttcctctttacttctacaggtattgatacataatacaatacaacatagatgaaccttgaaaacattctactaagtgaaagaagccagacacaagagaccatatattgcactattccattaaaatgttcagaacagataaatccgtgagacagaaagtagattagtggttgccagagactgggggaagggggaatggggagtgactgctaatgggtatgaaagccttttgggtgtgatgaaagtcttctggaattatagttatatttttaccttgtatcatgtcaagaaataaacttcagatggagtaaagatttaaaaatagaaaataaagtcatgaaagaacagttggacctccgtatctgtgagttctgcatccgtggattcaactaacaacagatcagaaatatttcttaaaaaaatatgtgggtgcggccaggtgtggtggctcatgcttataatcccagcactttgggaggctgaggcgggcagatcacgaggtcaggagatcgagaccatcctggctaacacggtgaaaccccgtctctatgactgtgccactgcactccagcctgggtgacagagcaagactccgtctcaaaaaaaaaaaaaaatgtgggtgcatctgtaccaaacatgtacaaactttttttcttgtcactatcccctaaataatacaatataacaattatatacagagcatttacattgtattacatattataagtactctagagatgatttaacatataccagagggtatgtgcaggtcatatgcaaatattattcaattttatataaggaacttgaacatccatggattttgatatctgaagggggtcctgggacaatcccccatatataccaagggacaactatactataagaaaataaagaataatatttctataatcttatattggggagtccagtctaaatatgacatggattagagaagttataaaagacatacagacttaagcatataaatatgacaagcttccagaagatgagagacttcttgaatggatactgttttttttttttaaggatgtttctatttacatatcttacccatttcctgtttagaaaaaaaaaatgcagctcgctgccagcacacatttctcagggcaaacaggaaatgggttaaaaggcctacgtatgtagtagacacctgctgggtggtctcctgattcaaccattctttctcttatattacgtggatcgggcctcaagccttggtcatctttcttcttgccacatggacaagaagcgcagggaaggcctttttacagacaaataagaataaaatatgtatgtgaagagggcagacataaatgatgcagaactgaatactgatgtcatgcaaattctctgttccagcctttttccaaggccaatatgcattcttgcctttggggactgggagacactccaatattcctctatgggtttcttctcttacttaaaagatgtttaaatgagtacattttattatatttaaaatgactccattttttgagatggagtttcactcttgttgcccaggctggagtgcaatggtgtggtctcagctcaccacaacctccacctcctgggttcaagcaattctcctgcctcagcctccggactagctgggattacaggcaccagtcaccatgcctggctaattttttgtatttttcgtagagacggggcttcaccatgttggccaggctggtctcgaactcctgacctcaggtgattcacccgcctcagtctcctaaaatgctgggattacaggcgtgagccaccgcacccagcctaaagatgaccccatttctttaactcagtaattctgccttcaggactatggaaacaggccagctgtggtgtcttactcccgtaatctcaacactttgggaggccaaggtggatggattccttgagctcatgagttcgagaccaacctgggcaacatgtcgaaacttcgtctctataaaaaatacaaaaattagccagatgtggtggtgcatgcctatggtcccagctactcaggaggctgaggtgggaggatagcttgagcccaggaggcagaggttgcaatgagccgaaattgcaccactgcactccagcctaggcaacagagccagaactcatctcaaaaataaaattaaaaaatatggaaacgctgcaggtataaatattaatccaatgattatatactgagtccctagtatgtgccaggcactgtttaaggccatgtggatacagtgcttctgaagacagatagccactgaagaattattgctttccttttttttgagacagggtctcactctgtcaatcaggctggagtacagtgccacaatcacagctcactgcagcctcaacctcccaggctcaatcaatcctcccacctcagcctccgagtagctgggactagctgggcacactccaccgtgcccagctagtttttgtattttttttgtagagacagggttttaccatgttgccctggcttgtctcaaactcctgggcctaagtgatcctcctacctcagcttcccaagtagctgggactacaggcctgtgccaccatttttgtatttttggtaagctaatttttgtatattttttgtttttttgttttgccatgttgcccaggcttgtctcaaactcctgggctcaaggcatcctccagcctcagcctcccataacgctgggattactagtacgagccactgtgcccaacctgaagaattatttctagcaatagaaacctcttagacagatggatgtccaataactgaggattgattgtggactatttaagtgacattagttacattaatgttacttaagcattaacatgctatttgtaataacaaggaaaaagtatgttattttgttaagtgaaagaaacgattaacttatagtttaatcataactatataaaacattttaaacctatatatagaacaaaaggtcggaatgatcaaagtgttcgcatctattatctttgactgatgagacactatggtagtatcttctgctgtagaaaatatccaaattttctattataagcaaacctactttggagaataaaataaaacaaagtcaaatattaagaagagctttgggaaaacagaacccaaagtgcaaggcatcagagaggtctccatcatctgattatgaaatcttggactctgaccccgcagcaatctaccagaaactctaggcaacaaggatgggacttcccaccccatgcacagaggtggccccggtaagaaggcagagtttgacagtcattgtgggtgctcccacccacagctcctgtcaggaagtggctgtgaaaccgggttcctcagagccatcgtggttctctggaggtaatctgggttggggagtggctggaggaagtaaataggggtccagcttcctttgccttctcagcctggtcctctccatcacaggtagctttccacaaactctaagttgaaaatacaagcagcttcttccgagaattgttcttgctctctagagaattctcttcattaacgctgttagtatcccttgactggaaggcaccatagcatttatgtgtaattcctgaatcacctccatgattttcagatattttaggaaccgggatgttttcctcaaatgaaatctcctgtgtatactcaggataaaagtgaaagaggggagaaaaggaaaaaggaggccttgtgctgctgtgaaacccaacagctctgaggaaccgggttcaaagccacttcctcaaacaggagctgtgggtgggagcctccacattgactgtcagcctctctgcattcttactggggctacctctattcaaggggcaggaatgcccagaccttctgcctagagtttttggtggattgtctgggagtcagagcccacagagtctgctgccagacctgaccacatcccaaactctgactcaggagtaagcgctttctttctctccccctggaatcctgtttcactgtttaagtgttattgcacctccccttctgcactcctgttccctggttccagggagcagaaagtaattacaggacacctatgctgtccattccgtcttcaagtagtccagaggcacccttggatttgcacagttatacttaaaaacccagaagacacttcgcccttgccctaggatcaccccctcaactccctagtccctggcaatcattagtctactttctgtttctacaaatttgctcattctgaacatttcatataaatggaatgatacaatatgtggccttttgttactcacttccttcatttaccctgagttttcaaggttcccccatgtggtatcacatgtattaatacttcattactttttatgggtgaacaatagtatggatatactatggatataccacattttgtttgtctatttttcagctgatgaacaattaggctgtttccatcttttggttattaggaaatgcaggcatacctcattttgttgtgctttgatttaatgagctttgcagacactgagtttcttaaatggaaggtttatggcaaccctgtatctagcaagtcgacaggcaccatttttctaatggcctgtactcaccttgttagcgtttcttagcaaaattttaaaattaaggtatgtacattgttcttcttacatgtaatgctactgcacacttaatagactacactatagtgtaatcataacttttatatagactgagaaacgaaaagaattgtgtgattcacattattgcaaaacacaacatttgttttatcatgatgttctggaatggaacctgcaatatctcaggtatgcctgtaatgctgtgaatatgcatgtatgcattttgtgtggacatatgttttcaattctcttgggtatatacccttaggaatgaaattgctggttcatatgacaactcttatgtttaacatagacctgcaaactgctcaggaactgcaaattattttccacagcaatgacactattttacattcccaccagcacgcatgagggtcccaatttctctacattcttgccagcacttactattgctcttctttttgattacagccatcttagtggacgtaaagtggtatctcattgtgattttgatttgcacttcctgacgattaacccatttatgagggaggttgcaattttttgaattgcagacgtgtgaaaaatcagaccttggtgatgaccttgagcagtaggatataaataactcccacaggtttagcattccagtagtggaacgctaggcataaatgggattcaacgatactggcatcttttcatgtgcttattatctatttgtatgttgcctttggagatatgtctactcaagtcctttgccactttttaattggcttgtcttttttttgttgattcataagagttatttacatattctggatattagacccttttcagatataggatttgcaaacattgtctcccacactgtgggttgtcttttcaatttatttattttgtgatggggggagattagggaatacgaagaatgcctgttctctttactgacggtatcatttaaagcacaaaagttttaaatattgatgaagctcattgtacctattttttttcttttgtcacttatgtttttggtgtcatatctaagcaaccattccttaatccaaggtcatgaagacttactcctgtgttttcttctgaaagtcttacagttttagctcttatgtttaggtctatgatccattttgagttaatttttgtgtatagtatgaggaaggggtccaacttcattcctttacaggtagatatacacttgtcccagcatcatctattgaattctttagttaagaagcactgaatcctagtccaacatcttcattttacagataagaaaattttggcccagaaagatcatgttaaaattactttgtgttgagaataaaagaaaatacatctgaaagaagatataccaagtcaataataataacaacaaaaaaagaacatacagagaaagagaaaactttttgtttctgttcttcagaatttctaagtccagtgagagaggtaaacagtacaacatgggatgttcaggactaatcacagaaatatacaaagtgggggtgaaatcatagagaaaagcctgcttaactgcctggtgatttaagctaagattcaccagggaggatcattctaggcaaaacaaacaaaaaaaaacccctcgtatacaaaagcctctcagctggaatgttatgggaagtgtacatgtggcaagatcttaagttgaggcaaaaggaaagcggagtgatgggagccaaagctgaagcagacttggagccaaacaccaggctgcatttgcccttgggaggtaggcaataggtttttttcttttcttttttttttttttttttgagacagagtctcgctctgtcacccaggctggagtgcagtggtgcgatcttggctcactgcaagctttgcctcccgggttcacgccattctcctgcctcagcctcccgtgtagctgggactacaggtgcctgccaccacgcctggctaatttttttgtatttttagtagagacggggtttcaccgtgttagccaggatggtcgcgatctcctgacttcgtgatccgcccgcctcggcctcccaaagtactgggattacaggcgtgagccaccgtgcccagctggggatcggtttttataacaaggcaatgacaccaccagatctgtgctttagaaatctgattgcttgtctgggcacggtggctcatgcctataatccgagcactttgggaggccaaggtgggcggattccctgaggtcaggagttcgagaccagcctggccaacatggtgaaacccccatctgtactaaaaacacaaaaattagctgggtgtggtggcaggcacctgtaatcccagccacttgggaggctgaggcaggagaatcgcttgaacccaggaggcggatgttgcagtgagcccagaccgtgccgctgcactccagcctgggcgacaaagcgagcctttgtctcaaaaaataaataaataaataaatctgattgcttgcaatatggacgatggtttgcaggaggtagaggctggaggaagggtttaggtgattcttgcaaaaggtcatgacaagagcctaaaaacagagtcctcagctcacaacgagttctcagatgcggctggcagatatgtgttgtttggctagaacagtgtttttaaagcatcttgaattcctgattggggaggaggcagaggcaagctctctctggggtgtcacaaccacaacactccctctttaggctcgcccaggcagaggcacccatttatgttaccagcctggccctggtaagcatttcagttgcaacctacgcctaaactaaggcagtgatgatgtagacagagaagagcacatgtactctcagcacaatttagaaagtgggctggcagtgctgctctttggtggtagagaacacagggtgatgttcgtctctggacttcaatgtgcctaactcacaccccatcccccagaatgatgacaaagcttttgctgaacttgctactctgaacagtttgccctcctggttcatggcctctcatggaagtaacaaaaagtacatagtcttttaaaatgtcttgggagctgtgttttctttcctgctgaagctttgtaaagtagaccttccaattctctaggaagcaaaggttcttttaaaccataggcttcaacttcccaaagttgtttaaggattctggtgctagccaatgatacagtattacttttgtcttcaactggtatctttcaaaggatttatatttctcaaaattaaaaagttgtacccggccgggcgcggtggctcacacctgtaatctcagcacttcgggaggccgaggcgggtggatcacaaggtgaggagtttgagaccagtctggccaacatagtgaaaccccgtctctactaaaaatacaaaaaaaaaaaaaaaaaaaaaaaaaaagctgggtgtggtggtgtgtgcctgtaatcccagctacttgggaggctgaggaaggagaattgggtgaacccgggagtcagtaccctagttccaagacaatattttattttcttttgaacttcattcactcaagtctttattcagagtgtaagttcctagagggtggggactgtgcatctcatttagcttagtaactcaagagcttaacaaagttcctaacccatggcaggggcttattgagaattgtacaggtttcctaccgtcaacactgttatctattagctcttttcagcttcagttacctgcaagcatctgggccgggttcaactgcaaaaggatctcacccatataagaggaaaaagggcagtagaggaaggaacctggaagttgacctctgcacatttctggatcttttttgtggtgctggcatgttgtgggcctggcaggaacaggcttccagttcctgtctgtcttatcactatctccacctttcttatcagttagctacgtggggggctttctgtcctacagatcctttatacttggcacgcttttttcttggccttactcagtactgagggtgaacatttgtatgctactatttattttaagtgttttgctttataaagacctatattctgttggtaaaactgttttctaaaattaaaacatatttattgataataaaaggcaaaattgcagctaaattttcttcttctgtgggagtgacacactaagagtacccttccaattctgtgatttgaaggttcaagaaaccacgaacgttcctgtgagccaaaagctttataatttgcttgagttgaaaatctacaagtgaattttaacaggataagcaatccgtaacaggaccaggaaactattcaaggacaagaatagactgtttttcttggttttagctacacaaatcaacaccaatccttctgataagacgagaattactctttcaacagttaccgacagtagcaaatgccacgaagatattaacaaacagcaccaatttaaagcctaagagcatggggaatgcagctggtgattcttacaaatgttaatgtaaactctgcagtttattccactccacattgctaaaaattttaccctgccaggcccactgcaacctcaaaataatactcttcccaacataaagggctgcttcttttaacttctccagagtgatttttacaaggaaggaaagttgccatatctctaagaccctaggggagtttagaatatgatcaagttccgaagaagtgcatttttgatttgtaaaaattattttaacaaatattggtcaaatgagtgaactgcattcatgtgcataaatatgtagaacatctgcaaacctctcacatgcatccagaggaatactactctcctgaggaggcttggagcaaggaggcctagcaaagatggacatgcaccgagcaatgtgcgggatctgggctggacaccatgataaatatcaaatgaaccagagggtccattaaaagctggctggagaaaaaagtcacataaagcgaggtgaatgtggaaaagtgaggggtgagttaagacaagctgaaaagctaaagaaatagaagtagagtgtttaagagaaacatgtacccagttttattgagatcaattcaaatcgccaggcactgtgctaggagacagggaacacaagctatttaagagaagctttctgcccttgattgtaatgagacagaaataaatctgcaattaacaatcataaaggcatactttcatcttgggcacttggaagaaaggaaacatagagctgacataaactttgatgtaaatgcagctttaagcactttttctttttctttcagtgatatggcaccttctccttttcaaaaatagcagcatattaattctctgttaaatcttttctttgaaatttgcgtttatgtctggcatgattttaccccatgtcacctggtcctgctccccgcattcttgttccttctggcaacacccacccaaatttcaacacatttttccgtcacaaatttagcattagcttaagtcattaactatatttacagcttgtcttcatccttactgaaacataaaggatggttgcaataaacagtgtgttttgtttatgaagaaaaatgtccattttaaatcagtctgcttgaatacatcatttctgtatttgaacatggctttggcagatgcagggaaggatgaaaactccacactcactggaaaacaaataggcagcattcttcattttattatgtgaactccccacacagtatgtcatgtggaatttgtgtgggattttatttactatatcacaaaagctgtccttactgtatatttatgcagaaaaaaaacaggctgcttttatgtaagtcaaatgtcacatcagaaaataataccccggaatgtctggaaagtattctggtgtttttgatccattaaaaaatataatttgtctttcacaacaacaaattaactgaaggggtaaggtatgtttaataaaaaataacgaggccgtctggctggagaccgagctgtcaggaacctggagaaggagatctgcaggctctttccaggggccgccctaacctgagacaaccaggaagacagcgggatggcccccagcacacaaggacccacaagagccaccgtcaccctgagcactcagaaagatactcagactgagcctgagcgcgtcttcactcagttccagtttcattcacgtgggtactcaaagatgcctatgcttccagttgtttctgtgttctctgtgttctcctgcagaatccattgaactggacttaagacatttatttcagacaaataagataaattatgtagtatataaaatgtaaaaggtggaaagagcaatttctgactgacacaggaacattcctggacacgagaaaattcaacccatcgatgttgagcgagactcagaccagacatgctgtttgtggctaatattagaagtcatttaactgtcaaagcaaatggcactttatgagcaagaaatcaactgaaaaaaatgaattatttatggttttgataaggtcataaccatcacaaaaggcaacaagggcaaaacagtaaaactgtctgttcaagtaaaagcagccctccctggaagaaggtaacttgcttcctgtctcactttcacattgggccttgctggctccaacgtggcccatgtgtgctatgtcaggggaagtatttctttcccttgccactatgtgggagcttttaatacagttctcaactctctatgagctccttgggtgtgtatattcccttaaaaattatctcagtgtgtaaaaaatttgttttaaaaacattttaaagaagaattggctgggcatggtggctcatgcctgtaatcccagcactctgggaggctttgggaggacatggcaagagggtagcttgaggtcaggagtttaagaccagcctgggcaacacagtgagaccctgtccctgcaaaacattttaaaaattaaggctggacgcagtggttcatgcctgtaattccagcattttgagaggccaaggtaggcagattgcttcagcccaggagttccagaccagcctggacaacatagcaagaccttatctctacaaaaagtacaaaaattagccgggtgtggtggtgcatgccagtagtcccagctacttgggaggctgaggtgggaggatggcttgagctcaggaggcagagaggttgcagtgagctgagatcacaccactgcactccagcttgggtgatagattaagattctgtctcaaaaaaaaaaaaaaaaaatcagctgggcgtggtagtatgcacctataatcccagctactcagaggctgaggtggaatgatcgtttgagcctataagttcaaagttatagtcatgttttgtgccattgcactcagcatgggtgacagagtgagaccctctctcaaaaggaaaaaatcagcggcaatagctcctaattccctctttgtaattttccgggcattaaaaataactggtcagttaggaggtggctaactctgctcaatggttgtgcaaaagcttaggataaaatacagaaacaggagctgaggaggcttctttcccttttcagtgttgtggcttcatataaaatctacatgtgagctctaatactggtccacgcatgcctgtgtggctctcagcgttctagaggccaaggctaagctcactataatataaatgaataaatgaatcaggactgttgagttctcctttcaatccccaagtcaagcacagtgtctaccacataatgtcaaataaatatttatggaaaggaagaaagggaaggaaaaaataaaccaagagaatgaaacagttagatcatgaatggcgctggtatccactgggttcccgtatttcttaagaaaatgaaccctctaaacaaaatagcccaagttttaagtttgttgaaacttcccttaaagatcagttctggggacataagagaaagattttgctactgctaacaaagtttgcaaaactttgaaaagaaaggttttggcacaggcaaaatctgaaaagagtaataatgagcagaaactggccctagcagacagataataaatcttcacattctgaagcttccatattaaaagtgtggaactggagaagaaataatcgacacagctcaatggatcacaacaacaaattaaaaatatataagggaatttcattttctataaaggtatacaataaaggtatattatattattataaaggcagcatttcaagaaaagagattgcttaataaatgtgtttcatgcaactaggtaaccatctgagaaaaataaagccagattccgatctcactccttataccaaaattaatttcagatgaatcaagttttccaaatgtaaaaatgaagccataagagaaagcgagggtgaacagcgaatgtgtgagtaatctcaaaggggcatggtctctttctatgcaggacacaacagtcaaacaaacaacaaacaggaaaaatatttcaacacagctacaaagggctggcttccttaatttagagagatactgtttatttcatccatcacactggcaaaactctagggagggcctgggaaaacatttactgagatactattgaagggagtgtgtgttagacgtgacatctctgggagatttggcagtgtttatcaaaatttagaaaacatgtatctcagcaatccctgagccacaaataatttatcctaaactcccactacccaaggttctgcactaaggtccagattccagaagaagtaatgcaatcccaagttcatccttcctactgtggtcaaggttaaaccccacaccccacgatgtgactgctgaggcgacttatcagtcccttgaagccaaatcagacaggcaccttacagacaccgcatcacccgctgccctgttccacctgccaagggtctgtgcctcctcactagactccagcatcttgaaggcagaacgatatcctttcccctgtctttctttctttctttctttttttttttttttttttttttttttttgagacagagtctcactctgttgcccaggctggagtgcagtggcgcgatctcggctcactgcaacctccacctccctggttcaagtgattctcctgcctcagcctcccgagtaggtgggattataagtgcccaccaccacgtctggctaatttttttgtatttttagtacagatggggtttcaccatgttggccagactcaccatgttggccagactggtctcgaactcctgacctcaggcaatccaccaccccgccccccaccgcccagcctcccaaagtgctgggattacaggcgtgagccactgtgcctgtccctttcctctttctaatatcacatttatatagcccagagcagaggctcaaaataacattagatggatgaacaaataaattactgaatgtgtaaatcagataaactagctagctagaagtactagtgggcaggttaaagacaggatggaatcataggtaaatggttaagaaaaaaaagagaaagggatccaagagtttagaatagttttctaataaatttaaggttagtcctgtgtgtaaaaactatctttatattaagtatgcaaaattatcttataatacacagaggaaccggagcagacaataatgaatgtcaggcatttagcaagctgggttagatttgatgaaaccgaaaactcttaagcttggaaactagcttgttaaataacaatgttcctgtaaacaggcaggctagatttattgtgcccctgggaaattctctggaatgaacacagaaaatgcttctgttgattagcctttttagcttgcgggtgagtgttgacctaaaagggaaaggcttgccctccagattttacataatgtgcccttatcaattcctgtcaggagaactgtccctgcagggatgttaggaagactaacgattctgcctcagtaacacaacctgtgctcccaggagcctgctgcgaaacagcagcttatctcttacacctgcttatggactagaaagaccaattttaaacagagggccaatgcaaagagaagagaagataaaggacattaataaagctaacaagttgattgatatattcaaagagaggaaaccgaggccgagcatgtgtgatcactggcccaaggtcacgagggaactggcggccagccccaggacacagagggcttccctcctccagccacctcctcaacgctagctggagagcagggaggaggcatttcccagaggcaagctctgaatactccgctgtgttctcactggacaaaggaaaggaaagatactcctctaaagacggcactgaacactcacttagagacggtaacagaagcctctgtcagcaactcaaggctcatttaaccaacttttgggatattacccacacagtcctaaaaacgtatgcaaagcaggaagtgagataaaagagacctcaaaaattctgagagtaactataaaattagacatattaataaacgtgcaaacgttataaaatgggaaaatatatacagttggtttttccggctgtggtagctaatcaaaaatgacatctccttccagctcccctcactcccaccatgccctcgtgggcaaaacctgctatgatttgcccgtgtagccccctctctgtgaacgtaggagaagcgaagccattggctttctgagacttgctcatcagaagccttgctgctgccacctgcgcctctgggaaagcttgccgtgggagaggcgcaaccgcctggagaggccttcctatgaggaagtgcgttagtcacgtaggagacggccccagctggcccggccacccagctgaggcgccaagctgcacgtgaaaaagccgtcttgggcatacagccccactgggcattcccgtgagtccagccctaacgtcatcggactgcagccccaagagagacccgagggagaactgcccactcacagaaccaagagggagaatgatcaacaatccacaaagtttcttgcaaagcaacagataactgaaccattggctagccaagctgtacaaaagcattaaaatagatttattgccataagacatgagaagtataaacaaaaaaaagttactaaacaattacagagcgcctatgcctcttctttgaatggaaggccttagaaatacttccatattttctgaggtattttgaaggagtacaggtctgaacacacagcacacagctgtcagaaggaaggccaggcatttacacagggtgggctgtggaagaagaaacctcgtaggcagcgggggacacaatggtgactgcaggaaggcctatgaggctgtcagctggaagactccttgataccatttcattaccagtccaaaacacagtcagctctgcttgttttttctcttacaaactctagtatgctgtagggttagagaggtacttatattgtaagcatacatgtgcaaataactgtgctagattatgtggcaacctgattttccctagatttgtcatcttatatttcaatcagacatgatgatgaagagccttgaactcaaattcaaatttaaaacaaagatgaaagcacagactagaacagaaaatcaaaaacacaattcaaggatagtataacaaaaacatatttcagatactgaagaaagctggtcctttgcaatagaccatgttccacggaggtctgccctctgacaagccgagggccttaaggcacataacctctttgagacttgagatcttcagaattgttttgaaactatttcttcattgggaagaaaaaatggttctgtgatcctcaatggtggtgaagttctaggtaagagctttaagcgaaacgatggaaaaaagcaagaactaggagctggtacgttagaagcatctactgcattcaaaccctgcattaggccccttcatacaaacctcctttagtcctcgtcatggccctgcaccaagggcttggtgtcccctctttggagaagccaccacacagaaaggtccagtcaccagcaagaggtcgtgcggcacgtccactctgagtgagtctcacaggggatctcaaatgccctctttcactctgcaaggtattacctgcactgtgggctcagcattccagagatacgcatgggaatagggccaggtccctgcctccaagagctgacagaaggctggaacaaacacacatgtgcacgcaccattcatttccacagaaagtcatttttggattcaaagctgcgtttgaaatgggtcttgcaggatgaatgggatttcacagatgaaaactggtagaagaaaactgcataggctcatggattcattcagcaagcacacacacaaaggcctgctgtgggtgaagggcaaattctgtccctgaagggcagagtgagtgctgggagcttcaagcatttcttttgaggtccgtttagcaaaagaatttcttattaaatagacaactcactttatattttgtcacatacactaaacacttgtgggaaattctctctgccattcagattttaaaaaattgattctggatattagctgttcccaaattcaaaggcgacatccctcacagcaaaaacctaacacaggtcctggaaaccgacaaggccctgctgcaggagctcacactcctgcggtccctactcccagggatcaagcctggctgctacaactctgtgtgcaagagcaaactgtttcttgtgatgagtcagtttcttttttgaatcaaaacagaaatgttaagaaaatatggagagctattcttttatgatcaagacaatttttgctatgctttatattcttttacagtttcctattttaatattctcatctggtagatttcaagcactgacctctccctttctttcaacaagggtataagaagacagactccacttgctcagactaggcatggggctttatggcctttgggatttcttaggggagacttgagacttgagagctggagaactgtcaagctaatgatgtaccccttttccttgccatttcaacacgaacaggtatttctctccaaatctagaaatccttctgtaaatggaacggcagatcattattttgcattttgctgagaacaagaagtacgtgagatattgcacaaagtacagcatgaggcatagcttttacccaacaggctcaaaactctaaattaaaagaaaacaaagggacagaaagaaaagcagttttcttctcttccacctcctcctcctctcgcctgaaatgtaccacccacggggagttgcacagcttagggcttaggcagagatgatattccatgtactttttcaggtttcccatttaaggctgtcaccaccattaagccaaatgacagtaacggaggtgcggtcacattaataacatgagggctgttctagggcaagatagggcctgcgtcatggcttcctctatccctgagaaggagggtgacagaagagaacgcctgcagggtgacagtaaaggagtgtatcagggatggggttgcagagcactgtgcagtccccactgtgggctgtcggagtcaatcaggcactcggctcattggaacttctgtcccctcagcagtaagggcggagggcaaaccttgcaaacgacacatcttagttggaggacatgattggggctggcatcatcaaccatatgagatgagcctacaacagacagcagtcagagacaataccccgggttaaaaaaggaatctaccccattatgaaatagaagaaacctcagcaagttgttgtctatgttctctgagctgataaaatggtattaccatgaactaagggtagctagtccctcaaaatccatgctaatgaaattctctaagtccagaaaaatgagcaaaaccatcattttaaaaaaatttagaaatttttatttttatttgcttataaacttcattgtgagcttttggaacaaaaaagtctgatttcctatttaatgaagaatggcttttaaacaccacaacttaatgcatagctgtatcaatattacgtaaattgacaaatgtcacacaaaatgtggtgcctaattgattttgacatgcacgtacataaagtaggaccattcaggtaaatacagagctaataattacaagaagcaaataataccaatgaaaaccattttttaagggtattagattttcattctcttcctcatcaaaaagaagcatgtattgaacatctgcctgtggctagggttgtagtaagcagaaaagtgacttgcctaaaggatgagaaatcctattacataaagattttttattttaaatgtaggcccactctccacacacccacacccatcagttacctagcagttccttataaggagtgtgaaatccaagtctggcaactcactggggacttcaagcaaaaccttctactctgtcctgttaggtgtgcagccctatgataaggcactgtggccatccgcagaataggcagaagataagcctctaatctgtacttttcaaccaatacctgggaggctttttaagagtgatactgaccttgttttcattggttttatttcattttacttaagtacttgttgccattgaaaattacagccggccttattgtcttcaattcatttgcatccccttttccaactactattcctaaagcaaatcatgcatttgcttttgtgcaagtgtctgaggactaatttctccctaaagatgcggtgttcaaatccataaattctcccccaaatacatgttgtgggttttggttcttcatatttttttatttttatttttttctgagatggtgtcctgctctgtcacccaggttggagtgcagtagcatgatctcgactcactgcaacctccacctcccgggttcaagcaattctcctgcctcagcctcccaggtagctgggattacaggcgtgcgccaccatgcccagctaatttttgtattttattagagacagggtttcaccatgttggccaggctggtctcgaacccctgaccttgtgatctgcccgcctcggcctcccaaagtgctgggattacagacgtgagccactgtgcctggccagttctcctcaatattaggaggaacattgtcaccaggctccctgtgaggtggcatttccaatgaccaaatatagttgttacttaagtcaaaactctatacctgccttgtccaatatggtaactgctagccacacgtgactaattaaaattagataaaattttaaaatctgctcttcagacacacaaaagccacatttcaaataacccatagtctcatgtggctagtagcaatgatactgaacagtgcagaaagttctgttgagaagcattgctctacattaagcttgtctaacctgccccacatgtggcccaggatggctttgaatgcagcccaacacaaattcgtaaacttgcttaaaacattatgagattttggccgggtgtggtggctcatgcctgtaatcccagcactttgggaggctgaggcgtgtggatcacctgaggttaggagttcgaaaccagcttgaccaacatggtgaaactccgtctctactaaaaatacaaaaaattagccaggcgtggtggtgcatgtctgtaatcccagctactcaggaggctgagacaggagaattgcttgaacccaggagttggaggttgcagtgagccaagctcgtgccactgcactccagcctgggcaacagagtgagactctgtctcaaaaaaaaaaaaaatatgagattttttttgtgactttttagctcatcagctatcattagtgttagtgtattttatgtgtggctgaagacaattcttccaatgtggcctagggaagtcaaaagattggacatccctgctctacatgatgcaagacgggtctgcttgtgatcttggttcatatagaatagtttctactagtatacattcaactgagaatattcaaatgagtaaaaaccacgtggactgctgcagccctccattcctctgcagaatccgggtgcaatgtaacatcaggcagtgctgtgagctgaagcctaaggacctagcacactcttgaccatatcctgaaactgttcccaaccttttcctgtgacacatttatacctcctaagtgcatacaacacacatttatgagaacacagtgaagcaaaaatgctcaagaaatggaagtgacttcagttaatttcaactcagggttgactcagtttctcctcacttttgtcaaaattttctgtgtaacatgccagtctgcattgcttctctgatagggcaggattctacagctaatgttaactaaatgaggatgttacattaattaaaactcattgttcttataatttcatgtaaaccaattaacaaatgcaaaagattttagaaaactggttttaacatttgactccaagatataaatagaagtatttcttttatttttattgtttgagacatgctctgccttccaggcttggagtgcagtggcgtgatcacggcttactgcagcctcgacctcccgagcttgagagatcctcctgcttcggggtcctgagtagctgcgactgcagatgtgcaccaccacacctgagtaatttttgtatttttcatagacacagggtctcactttgttgcccaggctggtctcagactcctgggctcaagcaatcttccccaccgccttggcctcccaaagtgctgggattataagcatgagccaccacacctggcctagattatttcttttcttctcttctcttttctttctttctttttctctttctttctttctttccttccttcctttctccttccttccttccctcctcctcctccttcttctttcttcttctctttctttctttgtctctctctctttcttttttttttgagagagtctcactctgttgcccaggctggagtgcagtggcacaatcttggctcactgcaacctccgcctcccagggtcaagccattctcttgcctcagtctcccgagtagctgggattactgggattacaggcgcgtgccatcacgcctggctaattttttgtatttttagtagagatggggtttcaccatgttggccaggctggtcttgaactcctgaactcgtgatccgcttgccttggcctcctaaagtgctgggattacaggtgtgagccaccccgcccggccgattatttcattgtttaaaacaaatactttgactttttaaaaactgaaatttgcctgtttttcccaaaagtatagtttttgtttgtttgtttgtttgttttttgagacggagtcttgctcttgcccaggctggagtgcagtggtgcgatctcagctcactgcaagctccgcctcccaggatcacgccagtctcctgcctcagcctcccaagtagctgggactacaggcgcccgctaccatgcttggctattttttttgtatttttagtagagacggggtttcaccctgttagccaggatggtctcgatctcctgactccgtgatccgcccgcctcggcctcccaaagggctgggattacaggcatgagccaccgcgcctggccaagaatagttttcaagaagcgggttaactgtgactaatcaagtacaacctaaactgacttgatctccttgagtagcctctggactttccccagagctgttatgaattcttgggaagcagctgatatattctcaaataaatacctcatttttatgtcagatcattctgatataatcttattttagaaacacagcccatagttcagtatatgacaacaatctgttcttagaatagaaatctgcaaaattaaaaaaaaaaggagcctccggaagcccagaagcatctttgaaaggtgtctctacaattttagtttcatagctctgtataacatccaaccatgcatgtaaacagctgaaaggaaaagcaacttcccttttatatgtatctgttagccattcttcctggactgtcagggaagccgatgtgggaggaggggctggcctgggatgagtatgggagaaaaagtgacttgcatattaattaacgcccatgctggccgggcgcggtggctcatgcctgtaatcccagcacttagggaggctgaggcgggtggatcacgaggtcaagagatcgagactgtgctggccaacatggtgaaaccccgtctctactaaaaatacaaagattagccgggcgttgtggcacgcgcctgtagtccccagctactcgggaggctgaggcaggagaatcgcttgaacctgggaggcagagcttgcagtgagccaagattgtgccaccgcactccagcctgggagacagagtgagactccgtctcaaaaaaataataataaaaaaataaaaaaaattaactcccatgcctcctctggcttcctttcctccatcccctgacattcatgtgcaagtggctaaaataggctaaagagaggatcaagtacagtttccgtggggaagaacatctaggtaggaaaggtaacgccatgcggtcttgaggctgggaacagacggacggcaaggctcaggctcctgtgcttgctcccctgagctggttttcaccaccagtggacagacgcctccctatccctccagctgcctccggcgcttgctgcccagaagcctccctggagccaagacctgagagcccaattctccagtggcctttttaattttaaattttgaatatttcttaggtttatatttctaaggctgcattaatgattattagtcgggtgaacttttacagtggttttaaagctaagtctgggtattctaggaaccatctaccctagcgacagcaatcctgtggtcaccaccatcagtcacactcctctggccacctggtaccatagtgatggaattgtgacatcaggtgtgtgcactttcgcatatagcttagactctcttttttttcttttttctttttgagacagggtctcactctgtcacccaagctggagggcagtggtgtgatctcacctcactgtaacctccacctcccaggctcaggtgatcctctcaccttagcttcccaagtagctgggatacaggtgtgtgccaccaagcccagctaattttttgtatttttggtggagatgaggtttcaccacgtcagccagactggggaccaatttataacattagataaatgtattggaagggcaatggagaatatttcaactgtgttagctattctaaaatatgttgagtatcacctcaaaaaaattatcattagaatacaattaattttaaaattatgagagcttttactatataatatttactgctttcctctccactacatcttcaataatttctctcttggtgcaatttttttcaacaatttattcaatcatttctctgtgtatgtacattcgagggttttcatttttggtgtctaaaactgaagctgtaataacaataaacatccttgtccttgttctggtgtgtcctttgtttagtttattaaaatttaaacagattaactgaggtaaaattgatatacaaagaactgcacgtatttagtgtgtgtaatttgatgaatttggacatacgcaaacatctatgatactatccccacaatcaaggatagatatatctagcacctcacaaagtttcctcatgtcctttttgttttgctttgttttttgtggtaaaatctaccctcttaacggattttcaagtacacaataccatagtgttaactacagacactacattgttcagcagttctctagaacttactcatcttgcatatctgaaactttcatacccactgaacagcaattccccatgttccctaccctgcagcccctggcaaccactattgtattctctgttctacgagattgactatatttatagatatctcaaataaatggagttatgcaatatttgtcctgtgactggcttatttcacttagaataatgtcctccaggttcatctgtgttgtcacaaatggcaggatttccttctctttttaagccgaacaatattccattgtacgtatatatcacattttctttatccattcctctgttgatggacaggtgggttgtttctatatcttggctattatgaataatgccgcaacaaacatgggagtgcaaatatctcttcaagatcctgttttcgcttcttttggatatatacctataaatgagattgctagatcgtgtaattctatttttcattttttgaacagctccagctgttttccataactgtggcattttacactcccaccaacagtgcacaatgcaagggctcccttttctcctccacatgatctccaacacttgtcttttgtggtttttttcataacagctatcctaacagatgtgagctgatatttcattgtagtttagatttgcatttccctgatgattagtaatattaaacaccttttcacatacctcttggccatttttgtatgtctcctttggagaaatgtctgttcaagtcctttgcccgtttttaaattgggttatttgtatttttcctattgagttgtaggaattcgttatatattttggaaattaaccgcttatcagatacacggttcacaaatatattctccccactctgtaggctgccttttcacactgctcattgtttcctttgttgatgtgtcccttttggagacaggcagtccattgtggtagtaaggaggtgaagtttagagccctattacctgagtttaaattctgccagtgtcactgttttaccttgatagatactttattctttcgcctggtttcctcatttgctaatctaggataatattaactgaatgtgacaggttcacagccactaaaattttatccaattaatgttcatcatctgttacttatcagcagattccaatttgaaccacacattggatatatatttttcacctctattctggaagctttgtggatacttaccagtaattccatatactcaccgacaaggagctttaaaaagtgcttctggacaataaaactacgacaatgtttttgagagtggtctattccctaacactacctatatacaccagtcctaaaatattttctgtgctacagaaagtaaagtgttcaaggatgtttatttgcaaagagtctgacagatatagctaagcttataaagatatatatatagatatatatagatatatatatttttagttattgagttcatcattgttagggtggtttcaaaatttgaagtttttcttatttctgtggtattttataacattaaacctagggatggcatcaaacacaatttcaaatgaatgtgttgctgtgctggatactgagaagtcagactacaaacctctgtcctcacatcaaccccagccaaccttaaattccccaagtgcaccaactaaaaagaccaagtgagcccttcatcagcacacttaccccactagcaaggacctgacagagttttcaccatatgttttgtgtttgtgcgtttgtgttttggttttggtgaaggggagaggacatgtcagtaggctcaaagctataactacagagccgactttaaatatgaaatggctttcataccttcatctcattgccagtatcaacaaccaaggacttcctggcaacacttggagattttagagacatcagtaacctttctaaaaatgattttgtgactttcattctaaatggctaggcaaacaaatcattcaatagactgcagaaaatgggccacaaaatgaccaggaggcacatgatatcatacacaataagagagtatggggacaaaattcagtttgttatgagatttaagtgcaaaattcctaactgacttaggtgcctggattaaatgtgttgggcaaatgaagagcaactgcatctccatgtgtcggaccgaaaggtccttgtataatgaccctccccaaacgaagagccactggtccaattcagtttgaggttccctacaggttatcaataaaggttttttaaaaacctgctggatcaatctggtggagggtgatttacagagtaactagaaaaagatttggcccaagatttggccacctggctgcttcccactttggccacagcgatggcttccctgctctggaatgccttccagacatttcccttcgtcttcttgctgccccttttgattctgccactcttaggacttctacatgaaaggaatacaaaaactcctacaatacttaaattcttttaaaaaggttgtttgaaagagctaacctaattaacagggaaaaaaatgcctttacttgcacttcaggacaattgtttctgctacagaagaacctttaataatcttcccaggctaaactgtggagacctttgattttatacaacccaaagcccactggaaatctgtctgcttcctccaactattgtcaaagaaggttaatttggaatttaacaaagtaaaagatttcttccaaactctcagcttgccttgggacttaagtgacgctgggtccgtttcctgcagccctgggacacttgcaagtgaggctctcagggagccttgttgactgcgttgggtgaaatgcacagggaatgcagggaatgtggcatggtgttctgtgttccttctcactctgcattgtttatgcttgctcaaataacttatatttgctcctcagttggaggttaaatttcttctgtatcatgactgaggcataaaattataaaataagtaagtataatctcctacattcctcacagcaaccatttccctacctccttccacacacaaacaacttttcagcagtgaagtggtacgtgtccttttttttttccttttaatctcaggatgatttagtctattaaggccatttaatggaatgaccagatgacaaagaagaaaaaggattgttttgagtaagagtttcctttttcatttctggctttaattgtgaggttatggctttcagaaaagaaaagaaaagaaaatgcctgtagtgataaaagagctgtatttcaacaaatgattatatttttataaatcttgtagaatttgtggatgtattttattaataaaatatttacacctcaagtttataaaggaatagacaaaatttacacagggtttgacagtcttatgtatttggtggtgaaattatcacaatttatatccactcgtacaatgctattaataaacaaaatgcttgtgacaagtatgggaattcttagaaggtaaaaattcccaggaaaacgattttaggctgaaagctaaactagggtatccctactaaaacaaggataccctaatgattattctctcctttaacaaaatttgaaagcacaccttttcctcctatattatgcagcatgtggtcataatttgtacttgttgctgtgttgaactcacaatagaaaaaataaatgaaacatcttttgagtaaactaaacagatgtctcatgttatccttttaaaatacagctggagaaaccttagagatcatcttgttcaacggttctcaacagatgctccctggaccatctgtatcaggaccatcttgggggtatattgaatgtgcaggctgtcagccccacaccaggcccagtgaatcttagagggtagagcccagacatctacagtgttaccaagcaccttatttcattcttccatacactaaattttgagaatctctgttgtcctatcttttccattttcaacaaagaaactcttacccaggttgtccaagatagagtagcagaggtaggcagaacttcatccaatagtaaaaataccacactgctcttctgtaatataacatttactaaaaactaaactatagaaaagcagaattaatatttctattaaagttctgcaacgtacagcaatattttaggcctttcttatccattcttttattccacaaaccttcattgaatgcctgcactacctaaggcatcgatgctgtagcagtttaagtttacaactgagcggagatgagacattacacaaagaggtacagttcaaggaaggctgccacaaacaccacaggagcaggttaactaaagggatcaaaaagttctaagcagctagccctcacctctggttcagatgacccagatgacttcacagaggaggggctgttctggccatggctgagctagcaacagatatggatggacaagggataaactcaccttactattctcgttccctagcaagtgtaaacattaaaggcttctgtcatcctggggctgcagccttcaaaggaagttctttatacaaactaaaaattagaggtgaaagaaaacaggatcctcattttaggtatggaatctctaaccctgcttttccctgactcccagcctcaaatactcctccttttcgggttctgttgtagatctcgatcctgtcctcctcccgcaacttatgatagggaatcctaacactcaccattgataatacattatccttttaggaggatatcctttgaggggactggcaatctccctggggtcagaaaatgagtacgtgtcagctaccagggtcatgcagccaccctgagcccaagccagtgttcctaccactgcagagttccctggcaagggaacacatggagatagtatctgggagaggaaagggaatccagagcagacttctgaaggctgtggggagggactgcaggctgcgaggctttgctcctcgctccttttcctcttcctactcctttagcagtaagagctccccaaccatgcttgggctatggccatgccatgtggcagtacagttagcagacaactgccctgctaagctttaaaaaacaaagacactaaaacctgataaacaaccagcttttctttgcttccttggatcagtaaattttaaaaagaagcaggggaaagaaaacagagaactgacctagaattgccaaccttttatttgggcatctaagaacatctgaaaaataagcaaaatagaaaagcctctatttcagtaaagagcaatcctttaagtagagtaaattcagactataaaaacaaacatatgatgttttatctgttttgtaaaaatcatttttccttggactagtaaaaactgcatcatgtcgccccatctgtagtacttagaaacagctgcaggctgtttaagtttctgtaagtttctataagcatagctcagagactcaaaagagaagggggaagaaggcttgggacaggaaaggaaagagcaaaagcattagggtttttcaagacgtaccaacaagcataaagttccactcgacaatttcagattttaaaacccctcatcatctataatccaggctatgcctgttctttgagccaacagaaccaaactggatgagatgccaatttaaaaatactgtgtgctctaaataaacttaaacatcagcagtgtagaaaaaccacattatatcaaaacatattgtttaaggtactaagaaatgtctctgcaaaacttaatatgagctttaaaagcatatcatgccaccatcaccatcagtcattaaatttttattttttcatttaagcttttattatttaaaaaattttcagattcaggccaatgttaaaagatatgaggcagaaaacaaaacctaaatattaaaaaggaagataataaaatatgtatttttggatggtgtgtttataggaatcaaatggtaaacaattacatttaatttacagctgagggtccctgtagtcacagttacttgggaggctgaggcaggaggattctttcagcccaggattttgaggctgcagtgagctatgactgtgcctgtgactggctgctgcactccagcctgagccatagagagaggccatgtcttaaaaaaaaaagtaggtcaatactagatatacaaaaccaaattaccagatactaccagtttgaaagtatagtaaaaaaagatcaaaacacaaactataaaataagtaataacataacaataaccataatgagaaatatgtaggacctatttagagaaaattggaaaattttgtgagaaatataaaaagtaagatttggataaatgcttagtacatgtcatgggctcggtggtaaagactaaaacctgttagataaacagtttttccccaaataatctgtaagttcaacataaattttccaaagttcatctgaaaaaacaaacaggaaagaacaacaaagaaaattttgcagaagagtcctgcagggggactggccctatcagatgccacaacatgtaagccgtgtggcacagacagaaggacaggcaagcagaacaatggaacagagaagataacccagaagaaacacccatccatattcagaagatgccacaaatccatcaaataaaattgagaaaagatggcacccactaggtaacaattcagaccaaaaacaagagcccctcacctgattctatatggtgaaatatattccacatgaatttagagtttagcaacaaaaattttgttaaggtagaaaaatatattgtatatatataatataaatatatacatatataatataaatatatacatatatatgtatatatattttttgagacggagttttgcttttgttgcccaagctggagtgcaatgcgcaatctcggctcactgcaacctcctctcccaggttcaagtgattctcctgcctcagcctcccgaatagctgggattacaggcacgtgccaccaagcttgactaattttttgtattttaaatagaaatgaggtttcaccacgttagccaggctggtcttgaactcctgacctcagatgatccgcccacctcggcctcccaaagtgctgggattacaggcatgagccaccgcacctggcctatatcagatattttaaatcacttctaggaaaaaaaatgactttctaagctaaaaaataatagaagaatctaaaaagaacagagtaacatattttatcatctacaaatcttaaacttctatttttattttttaaatacacttaaatgcaaacaccaaattggaaaaagtatttgtagcaaaggtcatcatcaaaagactaatcgctttccaataaacagtgctataacatttgtataagatttttggtagcccagtaagctaagacaagctttggggaaggcaatttggcaatacatgtaactggagccttaaatatatttgtatctgtgacccagtaattccacttctgggaatctagcctaaggaaacaatccacatataataaatattctctgtgtacaaagatgctcttcacagggaaaaaaactgaaacgatctaaaagtatattaaagaacagttaagtaaatgatttaaaaattttaaatggtacttagagtgtataatagtatttcaaagtgtttataataaaatgttaaagaaaaaatcaagatactaaattgcatattcaataaaaatacaattttattttttaaatatagatttatatatgaaagtattaaaatatttatttaaacactattatatccattttatatgtgtatgtacatatatatgtgcatatgtcatatgtttacacatatgtagaaatatattaggtataacagaaatatatgcaataggaatatacacacacacatatatacacgcacacacaaatcacctgcttaatgcctttaatctattcaaaaaagaaggcattgaggctaagacatcaatgtattattaccatttgtttcaaagtgtaatataattaattctcagatcatcctaaagttccaattttttccaaccaaaataaagtcataaaagaaacacttggttaatgaattaaacgtatattaaagagtccttctcatatttaaagctatgaggcatttaaatacaaataaaatcatttagtttcctaaaatggtgagcaacacaaaaacattctggataaaagttctttattgtttctacttccagcagcgtacatcctgaacctacattctctccctagataaggagtggctctggctcagtgtccccagagttccagcagctctcatgcattttcacccctgctattagaatgaccccagtgtgtagccgcacacactgactgcagcacagaggaatgcgggatggcatcagcagtgctaaagagtggggctaaaagcccagcgagaatcacaggagaatgcagaactgtgttctgaggcagcagggatggactggatctaatctagtgctataagtgcaaaatgcccaggaaatgtgctctgtggatagccaaggactcctgctccccaagacagagacgcaaatctgctcccttagttgggtaaacaactctgggaagataaataagtgagcaggcctccaagtaaatcaacccacagcatgtgtgcataacgttttagtgttaaatacaaaataatctttgactgattgtcatttcaagtgtttataatattccaggggtcctgtcataatgttcttatcatctgtaagctgaaagacatatcagaaatttattaagtttgtaaataaaactgctatgtttgagatcacttgattagtgcaaagtttaatctattttgtatgaaatactttttttctctgttaagatggtaagtttgcttctcagacattttaaatacttaaaatatatgaaacctacaaatgtagttttaaatgtctgagggaaatctaattagctaaaattaatcaacaatcagtcttattttatgcaaaaataattagattcattaatagaataacaagtcttataaattgaaaaggaaaagaaaaactagctttaaaaaagtctaacttcagtaaactgaatgctacttttgaacaccagtaactacaacagttcttttggacattacaaactagcattaactcaccccaacctctccagcagccaggctgcagagatgtaagctaggctccacggagcaggcacacccatgggaaactttgatatgaatgtcatggcagtccctagcctctcctcagtcctctcccacttttagctggcactgagtaatccattccttcctccagaagagacccagtgctgtgagacattattcagtcaaagtggttttacaaaagtcatttagtaaatggcttactaaactacttagtaaacgactaagtctttggtaaacgacttcactaaactgctaaccacaggaaaatggttagtagaattaatatctttcccacataccacatagcaaaacaattttaatttcttccattatttgtgtcctttcctctgctcaaaagttgcctttcccgccagcttcactgtctctcttttctcctcttccacccctctcttcagattcagatctggctgtcaatggcatgccccgatcagcaaaacaaaagttccaccatgggccagagagtggccatccaccccgaccttgagtccacctcgccaaatgtgaaagcccaacgaaactgggaggggacggggtgggatcccgctgccaaggaaatgagatttttctcctgtcatttaaaatgaactgattgttatacataatttgaagcgaaataagagataacaggaaacaggccacctgaaggaaacagaagcagagccacttcactattttgcttaactcttcatgccaccagtaaggatctttaaactggaaaaggctggagcccaggaagagcatttcaacaacttcaaggcgcagtgaattactcccactgcaatgaaaagcaattacatatgtttctgtgcagccattgttggtgtagtttcctaagggaaaaaatggacagctgtcaggaaatggaagccagaggaatgtttctcggttttctgaaaagagcaaagagtaatgttctggtaaatatggcctggaatcctaatgaaatcctaggacagactgttagatgaatgttcggttgtgaaaggaatagagtccgctcaataaaaaatatgttgaaaaatgattaggctatcctctagtccttcacagaggacttggtgagacagtacatctctatcaaactgctaatgggggaaaggtaatcttatttcactacatctacatctactgttaaaaaaaaaaaaatagaatcatcagaaaatcaatgccagagagtgaaagctataaataagagactctgccagcgagatgtctacttgttccagtgcagcccggtgaagcctgcatagagagcttgcatcagtgcatgctctctaaaaaggtatgagggaggcaagggcactggcaccaggccaagctctacctccctgccaggtaccttggtgcagggcccacattctcctagagcagcatcttttccaaagatactttttgtggccctatgaacaactgaatgaagtcaggagctggaagctcaaatcccccttcttccatgcaatactctgaaaccctccctgggctgcagtcccttatgaatggatgtgaggtggccttccagattgacggtgaggactaaatgtcaacaggtagtaggagcatcaaatgcagtgcctggtgccatcataggaaaatccccaaggggaacagagctctgaagtcctcctactctccaattctgagattctgtgaccagagtttgaaatcggaaacttgactcagatcctttttggtcatcttttctttgcagtaaaaatgtaaaatgtgaactgaaaaaaggggattccctgaatggtagtttgtctttctattcttcccatcttgtagagttcaggcaaccctcatcttattgtgcttcaccttattgcactttgcagatattgacttttttataaattgaaggtttgtggcaactctgttcagcatgtctactggcaccattcttccaacagcatgtgctccctttgtgattccatgtcaccttttggtcattctcacaatatttcaaactttttcatcgttcttatatctgttgtggtgatctgtgatcagcaacatttgatgttaccactgtaattgttttggggcaccacaaaccctgcccatataagatggcagccttaatctacaaatgttgggtgtgttctgactgttccactgaccggccattcccccatctcttcccctctctgcaggcctccttattccctgagatacaacattattgaaattaggccaattgataaccctgtaagggtttaagtaaaaggttcaaatgttcaagtaaaaggtctaagggttcaagtaaaaggtccgtcatattaaatcaaaaactagaaatgattaaacttagaggaagccatgtcaaaagatgaaatacgctgaaagctaggcatcttatgccaaacagttaagctatgaatgcaaaggaaaagttctgaaaggaaatcagaagtgctactccagtgaacacatgaatgataagaatgcaaaacagccttattgctgatatggagaaagttttagtggtctggatagaagatcaaaccagccacaacattcccttaaatcaaagcctgacccaaaacaaggccctaactctcttcaattctgtgaaggctaagagatttgaggaagctgcagatgaaaagtttgaagctaggagaggttggttcatgaggtttaaggaaagaagccatctccgtaacataaaagtgcaaggtgaggaagcaagtgctgatgcagaagctgcagcaagttatccagaagatctggtatgataattgataaaggtggctacaccaaacaacagactttcgatgtagatgaaacagccttctattggaggatgatgccatctaggactttcatagctagaatggaaaagtcaagtcctggcttcaaagcttcaaaggacaggctgtcttgttaggtgctaatgcagctggtgactttaagttgaagccaatgcttatttgtcattctgaaaatcctagggcccttaagaatgatgctaaatctactctgcctataccctataaaaggaacaacaaagtcgggatagcagcactctgtttacagcatggttggttgaatattttaagcccactgttgaggcctactgctcagaaaaagattcctttcaaaatattactgctcattggcaatgcacctggtaatccaagagctctgatggaaatgtacaaggagattaatgttgttttcatgactgctaacataatatccatgtgcagcccagcccatagattaaggagtaatttcaatttttgagtcttaatatctaaaaaatacattttatgaggctatagctgccatacatagtgatttctctgatggatctgagcaaagtaaattaaaaatcttctggaaaggatttgccattttagatgccattaagaatattactgattcatgggaggggttcaaaatatctacattgttgattgattccaaccctcatagatgactttgaggggttcaatagttcagtggaggaagtaactgcagatgtggggggaaatatcaagagaactagaattagaagtggagcctgaagatgtgactgaattgctgcaatctcatgataaaacttgaacagtcaagaagctgcttcacgtagatgagcaaagacaatggtttctcgagatagaatctactcctggtaagacaccatgaacactgttgaaatgacaaaaaaggatttagaatactcataaacttagctgataaagcagtgacagggtttgagaggactggctccagttttgaaagaagtcctaccgtagatcaaatgttatcaaacagcatcccatgcttcagaaaaatctttcatgaaagagagtccatccacgtggccaatttcactgttgtcttcttttaacaaattgtcacagcacctcaaccttcagcaagcaccaccctgatcagccagcagccaacaacctcgagtcaagaccttccacaagcaacaggattatgacttgctaaaggttcagataatcactagcatttttaacaatgaaacattttaaaattaaggtatatatattgtttttcagacacaattaataaactatagtatagtgcaaacatattttatatgcactgggaaaccaaaatattagtatgactgactgcattgtgatatttgctttattgtggtggtctggaatctaacccacaacacccccaagatatccctataaacgataaaaaaacaaaacttctgaagtaataggtttatacttgttcccctgtgaaataaggtgctgaagagtcacaaaatcatgctctttgctgccctgtgttttttcctttgtgttttgatcagatactaggaagcaacatttatctaacaggtagatttttacacaaaaggttgggaaattccatctgaccaggtctagtttttactggtgatttcattaagtgtgtggggggccagatggatagaaatgaagtcacttaagggatacatattgaaggatgtgcactacctacatatctgagattttaaaatatgcaaaattggccaggcgtggtggctcacgcctgtaatcccagcaccttggaaagctgaggtgggcagatcacttgaggtcaggaatttgagaccagcctggccaacacagggaagccctgtctctactaaaaatacaaaaattggctggatgtggtggcacattcctgtagtctcagctacctgggagacggaggcaggagaatcacttgaatcctagaggcggaagttgcagtgagccaacatcacgccactgcactccagcctgggtgacagagcaagattctgtctcaaaaaatatatatgcaaaattgaaaaaagcatacacataaaggaatatgaacataggtgtcttggcctgttgtgcggctataacaaaatcccataggctgggtaggctctgggcagccaaaccccatggctttgctgagcacagcccagagcacacctattgcgagctgtagtcaggtgcctgcagctctcccaggctggaatcgcacaccagtggctctactggtctggagtcatgtggtggtccaccctcacagcagcctctgcttggctcacttgaccaaggcttctagctgctacattcttcagaatctaggtgggtgtatcaacacccctacagcttgtgcactctgcatacctgcaaagatggcactgcctgggggctgacaaggtttactgactctgtctcctggaggggcagccactgccacacctgggcctactaaagccaaacctggggtagctgaggatccctgccctagaatgtggagagcagagctttgagatggtgcccagttgtgcagcaagcacaggggtcccacagttcatccttggcccatcctttcaaattgttctgccaccaaggcccttgcattctggccttgtgatgacagtggtagccccaataatctcgaaaacgtcttcaaagtcattcttccatgtcttcatgactagcacctggtggattcacaccaatctcatcaaagagttgcttggccacacccttgctgttctctcccaaacacacttccacagtatggacaggtttagaattgtccaaatatttaagttcttcttccctcttgattgaaaattctgcttttaaatcattattctcttctcacattttactataagcactcaacagacgccaacccacatctttgacactttgcttagaaatttcttgtgccaaatatcctatttcattgctcataagttctaccttccacaaaatgtgaggacccaaacacaacttagttaagttctttgccactttataacaatgatcatgtttcctatggtttctaataacatgttcctcatttccgagacctcatcagaattgcctttacagtccatatttctgacaatattctgatcacaaccacttaagcattccgtaagaagatggaggctttctctacagctctccttccctccttctaagctctcaccagaattgccctttagggtccattcacagcaatctaagctttttctagcatgcacctcaaaactcttcttgtctctatccattatccagttccaaagccacctccacatttctaggcatttgttataacaacaaccacactcccagtaccagtttctgtctttgttcattcaggctgccataacaaaataccatagacaaagtagcttataaacaacagttatttatttctctggaggctgagaagtccaaattcaaggtgtcagtagacccagtgtctggggagagcccactctctcttatatagtgccgccttcttctgtcctcacgtgatgtaaggaggcagggcagctctctggggcctcttctacaagttcactaatctcatttgttacggctccactcatgacctaatcacctccaaaaaggccccatctcctaacaccatcagtttaggggttaatatttcagcatatgaattttgagggagcacaaatgatatggtttggctgtgttctcacccgattctcatcttgaattgtaactcccacagttcccatgtgtcataggaggaaccccagtgggaggtgattgaatgatgggggcggatctttcctgtgctgttctcctgatagtgagtgagtctcatgagatctgatggttttaaaaaggggagtttcccttcacaagctctctcctcttgtcttgctaccatgtgacatgtgcctttcaccttcctccatgattgtgaggcctccccagccacatggaactgtcagtccaataaacctctttcttctctaaattgcccagtcttggatatgtctttttcagcaacatgaaaatggacgaatacagtaaatttgtatcaggagtggagtgctgctgaaaagatacccgaaaatgtggaagcaactttggaactgggttaacaggcagaagctggaacagtttggagggctcagaagaagacaagaaaatgggagaaagtttggaacttcctagagacttgttgaatggttttgacaaaaaatgctgatagtgatctgaacaataaggtccaggctgaagtggtctcagatggagatgaggaacttgttgggaactggagcaaaggtgactcttaccatgttttagcaaagagactggcagccttttgctcctgccctagagatttgtggaactctgaacttgagagagctgatttagggtatctggcagaagaaattcctaagcagcaaagcattcaagaagtgacttgggtgctgttaaaggcattcagttttataagggaagcagagcataaaatttcagaaaatttgcagcctgacaatgcaatagaaaaaaaaatcccattttctaagaagaaattcaagccagctgcagaaatttgcttaggaatgaggagccaaatgttaattcccaagacaatggggaaaatgtctccagggcatgtcagaggtcttcacagcagtgccccctccctgcccatcacaggctcagaggcctaggaggaaaacatggttttgtgggccaggcccagggtccccatactgtgtgcattctagggacttagtgccctgcatcccagtcgtgactaaaagggcctaaggtacggttcaggccgtggcttcagagggtgtaagccccatgccttggcagcttcgatgtggtgttgagcctgcaggcgcacagaagtcaagaactgaggtttgggaacctctgcctagatttcagaggatatatggaaatgcctggatgtccaggcagaagtttgctgtagaggtggggctttctttcattgagaacctgtgctagggcagtgtggaagggaaatgtgaggtcagagtccccacacagattccctactggggcactgcctagtggagctgtgagaagaggaccactgtcctccagaccccagaatggtagatccaccaacagcgtgcaccatgtgcctggaaaagccgcaaacacctgaataccagtccgtaaaagcagctgggagggaggtggtaccctgaaaagccacagggacagagctgcccaagaccatgggaatccacctcttgcatcagtgtgacctggatgtgagacatggagtcaaaggagaacattttggagctttaagatttgactgccctgctggattttggactcacatggggcctgtagcccctttgttttggccaatttctaccatttgtaacagctgtatttacccgatgctgctacccacattgtatttaggaagtaactaacttgcttttgattttacaggctgataggcagaagagtcttgctttgtctcagatgagacattggactatggacttttgagttaatgctgaaatgagttaagactttgggggactgtcaaaaggcatgattggttttgaaatgtaaggacatgagatttgagaggggccaggagcggaatgatatggtttggctgtgttcccacccaaatcttatctcgaattctaactcccacagttcctacgtgttgtgggaggaacccagtgggaggtgattgaatgatgggggtgggtctttcctgtgctgttcttgtgatagtgaatgagtctcacaagaactgatggttttaaaaatgggggttttccttcacaagctctcttctcttgtctgccgccatgtgagacattcctttcactttccatcatgattgtgaggcctccccagccacgtggaactgtaagtccaataaacctctttctttcctaaattgcccagtcttggatatgtctttatctgcagcgtgaaaatgaacgaatacaacaaacattcaaatcatggcaatagaaaacatttatataggatccctcagattttttttgaaagcaacaacttatttaattttcatcaatagttatatttagtgatcatatttcagaatgtttcatataaaatctattagacaaatgaacacaacatggttattacataatgctaatacaggtggagcacccccagtctgaaatctgaaatgcttcaaaatttgaaactttctgagtgccaacatgatgttcaaaggatgttcatcagagcattttggatttcagattttcagattacggatgctctacctgttaggtatctgcaaatattcaaaaatctgaaaaatatctaaaattcaacatactttttcacaagcaatttggacaaggcataatattgaagaattactcccaccttgaattctctttggagtgaggaaacaataaaatgcttattaaatatatggaaatacataggttatagataacagagaaactaaaatgtattgatttttggttcattttgattccgtttcagctaatatggatggttgaaatgaagtataaacagatgaaataagaacaaagataaggagtgttagggtgggtccctaggaagggaatgtggaacattactgggatgataataattatccaattaggttaatctctattattttgtacattcaatcagtagccctgaaaagataaagccaatgtttcatgaggcagaaagtgacttctaaggaaagaagcccccacaaagccatgatcctcccaactgttaggtaaaagtggacccccactagcatgaagaaataatcgtctcttctgtttttaattatatatggacagacaagttccaaatccttattttatgttttctacttcaattattcctttcctattgcaatttgagttcattttctattctgctctcaattaagtgaagtcaccattttccctttaatcatatgttatcctccaatttactttcctacttcatttacttccttactattgtctttgggaagttttatcagctcttcagatgggcagaagatgtggtggcagggaaaggggcaggggctggctggagaccacctgacagggagtcaaggcctgtctcaccaggtgtgtgagcacaggcaactgtggagccctctgaaccccaacctcatcttcagtaaaatggaacagccacatctacatcactacaggtttgcttgaagtttaaagctattctacattaggagttcaataatcataataaagttgtcagttttctttttacctcctaatcaatgtgttagtccctgaagaaaatcattaagtaaaaaggaccccaccgacccactcacccacacactaacacaaaatagttgtccaatggcaggaagttggattaactgattaatttattcaggaaatatttatttacattttgatctactccatgccagatactgttataggtactgaggatacagcagtgagcaggcaaaagctcctgctctcgtggagcttctattccagtagggaaaacacaactaataaaatgaatgagcaaaatgtatagtatattaaacggtggttaagtgccattagagaaagagaaggaggaaactcagggtggggggatggcaaatgtgatcttacagggggttcaggcaaaggtgacatggaaatgagactggaagtagtgagtgaggagctgcatggctgtccagaagcaaggagccacctgaaaaggctctggggcaggagtgtgctgggcacgtgaacacagccagggtggctggaaagagctacaggggaaagagaaggaggagatggtgagaagggagaggtacaggccttcctttggctttgactgagtgagatgaaagggcaagccaagttctgagcagagaaataacatagtgcagcttacctttaacaggatccttctggttctctgaggggtgcagtgggaacaggctgcaacagggcaagtgtcacagcagaagctactaggaggctacttcaacagtacaggtgagagatgataagagtttaggtgagggtggtaagcagtcacatactggatctattccaaaagtgcagcctctgcagagtttgctgagggactggatacatgcagagctgagagaaaaaagtcaaggatgaccccaaggtttctggcctcaacaagttactagctgtataaactgcatacaaacttgtttctgaccccgaggactagatgagtaatcaatatacatgaaggcacagcccagtgtacggcacatgggcttgtgtggtatgcttaggttcaagtttacaaactctattgaatttctactttgtgctttgccctgactttgctaggtccagaaatacaaacatgagtaagtgtgaaatccaccctcaggagtttatgatctagtgagacaaagaatcatcctttatagtacaagcttccccagcagccacagaaatgagtagaagattcagatgtcagcagggaagggaatgattgactcagagggaggatatctaggagggctgcctggagtaggtgacaacagagtagtggtgtcttctcaagaggaaaatcgatgaggactggcacagctgggaaaaaggtgataaagaggacagtagtggctagacttctcaagaagaaaatcgatgagaatggcacagctgggaaaaaggtgatagagaagggcattgacggaacgcttacccgctactgaatgatgatcacttattgttgaagatagagactgtgtctcttctaacaccacaatcctgagatgtaggcacgacatcctgaagatcgcaatgtgtacacagtttcttgtaaatattctgcaactacatagttatttgtttgactgttcctgctttcacaattataatttggtccagtcaactctagtcagcaatataacattaccttgtacacctccaaagcaaaattgtgcaaaagtatagctgcctgaggaggcaagtcctgatccccactccttggggccttctctatccatagatccaaaaaaccacagatgcttctggtgtgttctgccaatgatccttggcagtaaacaagtgtcacgtctgactaggcaccatggctcacacctgtaatcccaacactttgtgaggccaaggcgggtggatcacctgaggtcaggagttcaagaccagcctggccaacatggtgaaaccccatctctactaaaaatacaaaaattagccagcttggtggcgggcgcctgtaatcccagctactcaggaggctgaggcaggagaatcgcttgaacctgggaggtgaaggatgcagtgagccaagattgcaccactgcattccagcctgggcaacagagcgagactctatctcaaaaaaaaaaaaaaaaagtgtcacttttaataacattactcaattgatgacatgtctgcatcatcatcaattatgattcaggtattttcatactgttctcatatactttgtaccagcccgtaattctgcatttgcttttattttcttagtaagatgaaataaaaggactacaaacatttagaataatatgaaaaaagaagccacaaatattaaccctctagttcatgtcatcaaccctgaatgcaactctatttccacaaattggaagaggggaaaaaatccagatagtaaatgaaatttttactatcatattttattctttaatttgaatcatgaagaactttgaaagtttattttgtgagaaaactggaaaattaaaaactaacagaaatagttcataaagaaatgcactttttaaaactttccactgcattctcttcctcttggtggtgaaagtatagattcaactgcttggaaaaaatatagactacgcgcccagtatcattagtttgaagtttgttctaactgtggtatagatagaggaagaaatcattagcaaactaaaggtaaaatacactcaactatatgaaaatcaatcaacagtcaggcttcattttttaaaaaaactttccattaaatcacaacacgcactcaagtttacaagggtcaagtcctagtaaaaacacctttaaaaatgaacaagaaaatcagagctattcttcattgatgttccttttttgtcatgaacctgttctgtatgaacaaaattcctttatttaataaattgcactaaggcatcatttgctcagccataatggaattactttgatccaacggaaataaataaggactagagaagtggaaatcaacaagtcagcaagttaacatctcagttgttgtatgctattcacctctaaagaaaaaaacactaaaggcccgacacggtggctcatgcctgtagtcccagcactttgggagaccacggcgggtggatcacgaggtcaacagatcgagaccatcctggccaacacggtgaaaccctgtctctactaaaaatagaaaaattagccaggcgtggcggcgggcgcctgtaatcccagctactcgggaagctgaggcaggagaatcgcttgaacctggaaggcggaaattgtcaatcccatttaagaaaactatcttttctatctaatatgccaggttttgacctaagtgattacaggcaagcccagcctctataaacaaaatgaggctgttcccacaaaacacactagaagggggcccttgccaggctccctgtctcacccacttccctccccatacatacacttggcggcttctggcttggagaagggtgagccaggaggaagcaaaactttccaactgatctatgtgtcatcgtttttaagctccatatgaagctcaagatgaatattttataaaggcacaaaccctgcatgccacaaaattttagttttcttacatgatcaactgtacttataatatcatgtaatatttatctagaaggatcttcttgtcacttggtaaaacagtgggtaaaaattaaagcccaatgcactgagaaactattaaatgaacaaattacatgttcaatcttaccgagtttcagaatctttttttttttgagatggagtctcgctctgtcgcccaggctggagtgcagtggagtgatctcggctcactgcaacctctgcctcccgggttcacgccattctcctgcctcagcctcccaagtagctgggactacaggcacccgccaccacgcccggctaattttttgtatttttagtagagacggggtttcgctgtgttagccaggatggtctcaatctcccgaccttgtgatccgcccgcctcggcctcccaaagtgctgggattacaggcgtgagctaccacgcccggcccaagttgcagaatcttaacaaattaggaaattagatatttgtcctctttttctgaaatcaggggaacttcggggaaaaagcagcaatctaagtagaccacagcaacaagaaattcctttatggaaaatttgcttgtaaaaatccaaataaagacgtatttgtagagggcaacctgaaggcaaaatatcatgctcatacaaaatgaactgcagaattgagaagcacaagtgcctggaggcagccccattatcaattctttgacctcttggagctgggtgtgagggctaaaaataaacttacttcaccagctgaactccttcaggccttaacatctaaaatcctggatccatagatgtgtttggataaaggacggagaccaggggtgggcaaagtggtagcaaaagggtggcgggtgctgcaggccacaatgagggttcaggatttccttctaaatgtgattagcaggagagtgacaggatgatttacatctgaaaaggactgctccaactgctctgcggagatgagaccaggtggatacagagaaaccaggtactggctactgcataatccttgtgagagacaaaggtggctcggatcaccaagcagtagagcaggcagtgagaagttatcaaatttggcatgcagctagaggagaaagccaacaggacttgatggtcagtcagatctggattgcagaggaagagaaagtcaaatctcttccacttttcacaaaaataaactacagattgttccagtagtcaagatacatcattcaaaggaaaactatggcaatggctataaacaaataatttaccaaaaaaaaaaaagatgtatgtgcaaatcaccacatcaaaagatttcaacaccactagtaattacagaaatgcaaactaaagcaaaaactagaatgctttcccctgtcttattagaaaaaaaaataaagataatcgaagtgggctgaacagtattcctcaaaattcatgtctatctggaacctcagaatgtgagagtctttgcagatgtaattagttaagatggggtcagatgggattacagtagaccctaagcacaatgactggtgtccctataagaagaggagaggacagacagagatacacaggcagggaagaaagccaggtgaagatggaggtagagactgcagcgatgcagctacaagccaagaaacaccaataggaactgcagccgccagaaactaggaagaggcaaggacagatcctcccctggaacctttagaggaagcatggccctgctacaccttgagtcagatttttggcctccagaactgtgaaaggatacatttttgttgttttaagccaccaagtttgtggttctttgtcacagcagtcctagcaaactgacaacgtaattgacagtattactgagagtgtgaaaagtacagtcatcctcaggcctgttggcaaaagcatagattagcacaacagcctttgggaaaaataatttggcaatgcttgccacaattgcaaatgaccagatcttttgactcagcaattccaatgtgaggagtttattctaaggagataattagaaacatgtgcaaagattttaaaagaatgttcctcacagggttaaaactggaaaaaaatctaaatgttcaaaaatttaaaataagtcaaaaaaactatggcgcaaacttacaacaaagtaccatgatgggaagatagtttggcagtttcttacaaaaccaaacaatcttaccaacccatccagccatcacactctttagtatttatccaaatgagtcgaaaacatatgttcacacaaaaatctgcatatgaatgtttatagcagctttaatcataattgccaaaacctgggagtaaccaagatgtcctcaaacaggtgaatgaataaacaaactgtggtacatttatttaccgcagtttagaatattatttagcaatacaaagaaatgagctattacctacaaaaaacatggaggaaaattaaatacgtatttggtttcttttacttagtaatctgaaaaggctggatattgtatgattccaactatctgacattctggaaaagcaaaaactgtgactgtgaagattagtggttgccatgggtttccaggggtggtatgtggaacaggtggagcacagagggtttctagggcagtgaaactactttatatgatactataatggtggatataagtcattatacatttgtccaaatccatagattgcagaatgccaagagtgaacccaaatgtaaaccatgaactttgcatgataatgatgtgtcaatgtaggttaatcagtggtaactaaagtaccgctctggtgtggatattaatagtgagggaggctatgcctacgtgggtgcaaggggtatacagaaactctctgtactttccactcaagtttgctgtgaacctaaaactgctcttaaaaataaagttaggccgggcgcggtggctcacgcctataatcccagcactttgggaggccgaggtgggtggatcacttgaggtcaggagtttgagaccagcttggccaatatggtgaaacctcatctctaccaaaaatttaaaaattagccgggtgtcatgatgcacgcctgtaatcccagctactcaggaggctgaggcaggagaattgcttgaacccaggaagcggaggttgagccgagatcgcaccattgcactccagcctgggcgatagagcgagactccgtctcaaaataaataaataaataaataaataaataaataaataaataaagtttaataatctaaaataaaaattaaaaaatgttcttgaaaaatactgggtttttttgttgttgttttgtttttgtttttgtttttgagacagagtctcactctgtcacccaggctggagtgcagtggtgcaatctcagctcactccaacctccgcctcctgggttcaagcgattttcgtgcctcagcctcccaagtagctgggaccacaggtgtgtatcaccacacccaactaatttttgtatttttagtagcgatggggtttcaccatgttagccaggctagtctcgaactcctgacctcaagtgatctgcccttctcagtctcccaaagtgctgggattacaggcatgagccactgtgcctggccttgaaaaagtatttgatgataaggttattcaagacatgtgatgtactattaactggaaaaagcagaatataaaaatataaactacagtatgattctaattttgtttttaaaaagtatatggtagcaaaatattatctaacaattggtgaatctggatgaaaaggtacataggagttcattatattattcttgctacttgtgtgtaggtttgaaactttttcaaaataaaaagtaaaagaattgaaaaaggccaggtacggtggctcatgcctgtaatcccagcactttgggaggtcggggcaggcagatcatgaggtcaggagatcgagaccatcctggctaacacagtgaaaccccatctccactaaaaatacaaaaacttagccaggggtggtggcgggcgcctgtagccccagctactcgggaagctgaggcaggagaatggagtgaacctgggaggtggagcttgtagtgagccgagatcgcaccactgcactccagcctgggtgacagagcgagactccatctcaaaaaaacaaaaaagaattgaaaagaagtggtacatacatgtattcatatgccattagacaaggcatagaaaacactacactattaatactggttatctctgagcgatgagattatgcacaatttcggaggtttgtgtgatttcttatattcgccaacatttctacaataaacatgtttgtaatcaggaacatagagttaatgtcatttaaaagcaataacaaatgcaagggtctaagaaacctaagaacattaatttgaaaaataacaaacctcttcaactaagctatcaatgccacctgctttgttgttttaacttacccatcacattcatgttcatggcctttgtaacctcttccattcctcccagcttcccccaggttcccgcgacctctttttcttttgcctggcaacctgtctccctatgcagagatgttgaacaccgcctaattcctttgcttgcataacaaagttcctcagaattttcaaccacaagttcttccattcctcttatcattttctgctctttagaaaaacaaagtgagaacaacagtgctcttggaaactaaaaatatggacagagaggggaaaaacaccgatagaaatttggaagataaagttgagaaattaccttataaagcaaaaaaaaaaaaaaaaaaaaaaaaaaaaaaaaaaaaagaagaagaagaaggaaagataaagagggaggagacaggagataaaaggtccaacatgagaagaagaaaatgtttcccaaatttcgaaggacattttctattttgaaagggcctactcagcaagtacccatcacaacgaatttaaaaagacctattccatggacatcagaacaccagggataaagagaagagcctaaaagcttccaaagagacagaagacttgagaaagtgtaaaggactgggatatcagaatagcactggatttagtgataacactgggaactagaaacaattaatgatgcctacaaaattagaagaacaaatttccaacctagaatgctatactcaaccaagctatcaagtgggcaggtgatataaagacattctcagtcattgtacctcccttgacactacagtagccaccactgatgtccacccctgcagccaccctcattcttccttgctaacaaattcaaattttattctgatattaagtggccatctgttttgaaggtggggcaccagtcccaagagggtgaatttattagcagacgccagttatggcaattccaatccctttgatacgacctgagatgtgaagttggctaggaggttttgagaaaataatctcctggcttttaaaaagaggctcggccgggcacagcagctcatgcctgtaatcccagcactctgggaggccaaggtgggcagaacacctgaggtcaggaattcaagaccagcctggccaacatggtgaaaccccatccctactaaatatagaaaaattaggccgggcgcggtggctcacgcctgtagtcccagcactttgggaggccaaggcgggcggatcacgagatcaggagatcgagaacatcccggctaacacggtgaaaccccgtctctaccaaaaatacaaaaaaaaattatccgggtgtggtggtgggcgcctgtagtcccagctactcaggaggctgaggcaggagaatggcatgaacccaggaggcggagcttgcagtgagccaagattgcgccactgcactccagcctggggaacagagggagactccatctcaaaaaaaaaaaaaaagaaaagaaaaagaaaaattagctgggcgtggtggtgcacacttgtagtcccagctacttgggaggctaaggcaggagaatcgcttgaacccaggaggcagaggttgcagtgagtggagatcaggacactgcactccagcctgggcgacagagcatgacttcatctccaaaaaaaaaaaaaaaaaaagaggctcaccagagaaaatggttcatttttaaacttccagctattgtggtctgcatatgacaccagagacatggcagctaccttgcagctatcccatgaagacaaaccctcaccttaaagaattgaaagttggctcaaagaaggagttgaaagttggaaagaacctaagtccttggaaatattaccaagcctaccctgtagccagccctaacaccagacttatgagtcaaaacgaagttcactttcttgatgcccaagtcctgagtcctcagcacctacaggagaaagactggtttcccactgtgcaaagacctgctgcagcccttagggtactgctccctggaaaccccaattctcataccatgctcacacaggattttgaggtgagcggggcatcctacccaccaagcagaatgtctttatgcactcgggccaagctggagtctgcagattagaacctgggtctctgaagaatagggtagctaaacccttccaggacttcacatggaacccatccatcagttaagttgttggaggcagaggtgggaaaccaacttagcttttaattttaattattctttaagtcttcatcacttatctcagtctaagcagagtttctaggctgatccagatttatgctccacagaggactgcgtatctgcattgaaatcagaaaacactctaaaaggcaacgtgatatttgtttatttgtactattaaaaaccacaggagaaaataccttatctggaaaaatagtttgaacttttactcacctcctcaaatctaaattgatatctaacacccattttccttgcaaaacaatagccggcagtagaaacagaacgtttatactaagaaatgttacagaaacctgagaagaaataaatacagtacttattttctatgtacactcactttctcctttaacatcaaagtgtgtttatatttttaaacactaaagtggaaagagtgattttattaggttcactccacccaagttcattgctacaatacctgactctctgccaaggtgcttagcctatcgctaggaagtcctaaacacaggcctgtttttaaacactttcaccactcccttagcctttccactttgaaaatattgtctggtatcatgtttacttctacattttaaacactgtttatatgtagaagtgtattttaattattgtcagcgattaatactattcttactatctgaatgtagattattctatatttcattaaagttgaaagtaattatatttgtggtttagctctaacaactgcactaataatactagtgataaaaatgcactcataaatcagtttgtataattattgatatgcataatgactaacaaaattgcttccccaataactctaatgatatgagagtaatcacctcctctcctaaaaataacacgctacaagcacagagaagtcccaacttatacacggattctgcattgtcaattatatgtgatggggtaaactaaaagagagtgacagattatctgaggtggaattaaatgatcaatgagccctgaaagacagggagaggagaacatacacctgcatggtaagagtacatcaacgggtgcccctctaacactcactagctgatacttttagctccagataactctgttgctttcagaccactggaggcagtaagctgtactatgatgatcttagggagagcagatgcaaataaataatatgctaaagattcagtcaccttattcctctacaatacatttacctgcattggtatctctcatgaaacctactcaaatgcagtcatgtcagcagttgcccactgcagctgaggtggtcccaatgcttcaggctcagagctggcatacagcacaccagatctgctcagtctcagaacttaactccaaaacccagaggctgacagagctgagttgctgtttctagaatgactatctcaagaaccgggcaaggcataatggaacccattagtaaattcagcagaagaaggaagaggcaggaaaataagaagggggaatgtactagtctgtcttcatgtttctataaaaaactacctgagactgggtaatttataaagaaaacaggtttaattggctcatggttccatgggctgtacaggaagcatggctgaggaggtctcaggaaatttacaatcatggtggaaggcaaaggggaagcatgcacatcttcacatggccagcaggagagagcaaagggggaggtgctacacacttttaaacaaccagatcttgtgagaactcactgtcacgagaacagcaagggggaaatccacccctatgatccaattacctcccaccaggtccctcctccaacactgtggattataatttgacttgagatttggatggggaaacagagccaaaccatatcacggaagttcagtctcataatgaaagcaaatctcataattatttttgttaagcatgcattcctctgttgactcaactaagactcaggctctgggaacttaaaatgcaccaggctttatctatgttaggagttatggggatatagaaaaataaggcatgatttggattcttggggagttcgcaatccaatgaggagaaagatgagtgtcttagtcacctgggctgctataacaagataccacagactgggtggctttaacaaatatttatttctcacagctctggaggctgggaagtccaacattacagctctggcagatctaatgcctggagaggcccgcttcctgctttgtagatggctttttgctgtgcctcacatggtggagagagaaaagaaaggcactggtccccttcttcatatgagggcactaagcccattcatgaaggctctactctcacggcctaatcacctcccaaaggtcctaccgcctaataccatggcaccggggagttaggatttcaacatatgaatttttaacacaaataggcagtccataaccacaagaaaacaactatttagttttgaatcaaatattaggtagaaccacacaaaattatgttaattgtagtgaaaaacagaaatatttgtagtcaaagaggtagcttggggccgggcgtggtggctcacgcctgtaatcccagcactttggaaagccaagacaggcggatcacaaggtcaggagtttgagaccagcctggccaacatagtgaaaccatgtctctactaaaatacaaaaagtagccgatgtggtagtgcatgcctgtaatcctagctactcaggaggctgaggcagaagttacgggaggaagaggttacagtgagctgagatcatgccactgcactccagcctgggagacagagcaagactctgtctcaaaaaaaaaaaaaaaaaaaaaaaaaaaagagggagcttggaaaaaatattctgggaggtgatggaactgttctgaattttgattgtggtggttacataacttattgcacttatcaaaactctcagaaactgtacaccaaatagagtgaatgctaccgtatgtaaatttaaaaataagttttaaaagcagctgaatatcagtaatttcatacggtttaacttagtagatgcgccagctcaggcagacagttctgcaggattgcaggaagcagagacgagcagagattaatagaggagtgatagtctcatgaacaacaaccatttcatcagagccttgaaaaaataaagccctcaacagtgaagaaaagaagggcaagaaggtaaatatcctagagacaaggacagcacaagcagtcaaaaagttctacaaactcacagcaggtgtggagaatagcaaatagagcagtagatagttcatgaaagcagggggatcacaaaaaaaaaagggggtagaatacggaggacttaaaagaccagattaaatacactagaatttattctacagtcaatggcaagttagtaaagtgtttagacaaaggactgacatgactaaatctattttggaaagataaccttgataaaaatatggaggatttgttggttgtgggaggtatcagaggcaggagaatgacctacaagggtttcttaattggggtctgtgaatttcttaaaatggttgcaatattgtgtatgtgcacacacatttgtacatacacacatctttttctagaagggggtctatggttttcattagctactgaaggagttcataacctccaaagggttaagaactttaagaactgtattgttcaagtgcatcaagatgcagcaggagttaagtttgcagtgagcagaataaattcagagacacttatgaagatcgcatttctggacttaaaaataactagtgagtgagagtgagagagggaggatctaaagatgacaacaaagtttctagcttgctgacctgggaagtgttgagggagaggaagggagagggaggaaaaggggtatcattacactaagaacaaaaaaatgatttcacttcaaagaactgaatatttaacctctgcacttgtgtcactcttagctggagattttcttctatttttatgggccaaagtatttctggctaaagagagagataagatgtactacagaggaccgtacttgcatatgaaaataaaaagcagatgagaaaacaatcttcaaagcctttctcagagtgagttcgctctccggaggcttgctttccacattctcatggcattaggaaacctcagggggatggtatctgcctctgtcacacaagggaatgaatgtaacatatagtattggaataagctgaagatagccatccaaacagtattaatatgttttaaacgtacaaaacatttcatatgacttgaggatttttgtaagttagaaattcgactcactagcatggattacaccttaaataaatatagtttcttccctggtgttttcatacatcatggagcaaatttatatttatttggtaaacatttgcttattaaataaacgtttgcctgaagttgaaaggggatgctatatagagctcccctaattgctctgttagctcatttgacctccagaggccctgggatccaaagagctgcacccccacctcaggaagcctggagaaagccaggcagcagcaggacagtgagattttgttcaacaaatctgtattcatagccagatactataatgggggttggaaaatacaaagatgtgaggggctctcagcttgtctgtaatgaagtgatcagggcagggcaagagtgtcagattcagtcatgtaggagcagccctgtgcagaaagaaccccacggccagggagggaggctccagggaacatatggctgtcaccatatgggagtcgagagggctgagaagacagacctccggggagagtatctgaggcttcctaaatgctcatacctcaatttatagcagagtgctgtcacctgaattccactcacactgctctgctgggtctcctcactaaagcaagcacacccactgagaactacggcacgcttgggccatctggcccctctcccacaccctgcaacacacacacatacacacacacacacgcacgcacacacatgcatgcacacacaggcacacactcaccaactgaggtctgtgaacaatacaacctcagtcagttgcactgtttcatttgtacatattaccgtaaccaacaaatgactgcaaaaaaactgttgttcaatgaatactctggaaatgcatgatggaggtagactgctaaaaaaaatgctgccaaatcaggtgtgaaagacattatctgtaaaaaggaggaaggaaaattgttaaaaagaaatctaccagatttccaggtgtccttaagtccttccaactgtaatacggctgtggttaacagaaaaacaaagatgtggaataaggcagatccatattaaaagaaatagcctgggacttctgtcaaataactggtgagtaaatgtgcatttctgtgtatgtaattaaaataaaatgtttaaggaatatatggatcattttttttgagattctgtttactggccaactactataagaattaaccaaaaacctaatgattccccaattcctcttctacataaatttaacaacctcccactgtcagccaacatcactcccattaccagttaaactcccttccaactggaaaatcattgctctgttactggtctttatcaaagatgatttccaaaccatacaatctcatttactgtgatgtagatttagctttacttgttaaaaaggattttatactaagatttaaaccttaaccattgccaaatcttccttcagtttgcccagtaagatttcatacaacctagaaaagaatttagagcctgaataaatatatgaagtgctctagcaaagcactttcttagtgtttgtcatcaattatattccagttgcaaaattttagatattgaagatcatttcaaaaaacttttaaaattaaaatttgaatgcaaagtatgtagctactttctttgttttggtatatggcaatgtaagatactagagagtaaaacattcaagttgtaactactgaaattaaatttgataagaaacttgtccttttattgaataattactttattcatgttttttgaaaaatgtattcagttggaggagctgtcctctttttaaaactgatgctttaaaatccacgttataaaaacattactaggccaaggcgggcggatcacctgaggtcaggattttcagaccagcctggccaacatggtgaaaccccgcctctacaaaaaatacaaaaattagccgggcgtggtggcaggcacctgtaatcccagttactcgggaggctgaggcagcaaaatcacctgaactcgggaggtggaggttgcagtgagattgcgccactgtactccagcctgtgcgacaagagcaagactctgtctcaaaaaaaaaaaaaaaaaaagatcatagctctttcttcagtgtcttaaaatatcaatatattagtatataatatatctctagcatttttgtaaggtctcagaagccctatgaaatgctctgggttggcacttgatctttacacacaggattcaacataacagagcaacttgagaagacagaactggatttcctgaatgggtaatgagctcctttacatttaattcactggaggctaacatcatccttaattaaaaaagaaaaaaaaaggtactattaaaattacatttacttcctacaatagaaagccaaaatggaaactaccagagcttcatgaattttaaagccctacgcaaacgttgttgcacaaacacaatttcctctagtcctagaagttttgctcaagttgtattagctccatacaacctgacctacttgttctaaaatatttggttgcaattcaaagatgggattctttcttatggatcccacatttatagagcaaatgtacctaaatgttaatatatgttcatcataaattagattaaaaactaactcaagttaattttagtatgtcattatacagtattaactaaacaattaggataaaccactacaaaacagtgagctgtgacatcatagagccatttcctttcaagccctacccttaatccactcttccacctgccaatacacacacatgcacgtgtgcacatacgcacacagaaccccccctccaccaccacctttcatggtgtatttttcaacccctttagagaattgacaaggatagaagacatttaagattaaggtccataaagtattcattattgttgttttctgctttctttaagaactgtctcgtcctatcaggacacacagctatgctagctcagctgtaaacaaaaggatacgaccttgaaggtgtctatagctcactggttttagatgccgactccacatcttcatcacagctcctaggtggtggctgcactgatgtgtacaataagataaactgaatcgctagctgaaataagcattttgaattttcatttgtatgtgagtggattcaaaagattaaagtgctatatccataattacatgctcactactattaaaaatacctaagctaacttctaattaaaagggtggatagtacatgtgtattacctcctctccctcctgaacccctgccaaaaacaatatataaggccacaaagaagaaaagatccaagtgaacaagagatgcaacacttttcagaagatggaaaatgaatacagaagtagttataggatgagaaatagcagaggctacagaggggaagaccacacagaaacaaatttgctctgcaacccaggctccaggcttaggggagcaggacccaaccacaaagggaatagtagggtgggtgtagggctgagaacaggggagtgaatgaatgccagcatatgcaacacttggatccccagatcctgcacagacactttctcccctgacctgcagagacagtttctcccaggaaaagagctggcttgctcaagagcttccaatttgcttcctagtgactcactgggttttctggtggtaaaatacacataacataaaatttaccatgttagccattttaaaataaacagttcagcgacattaagtatactcacattgttgtgcaaccgtcacccccatccatctctgggactttttcatcttcccaaactgaaactctgtacttatcaaacactaactcctcactccctctttcccccaaacccctgccattctactttcttctctatgactctgtctactgtaggtacctcatgtaagaagaatcatccagtatttgtccttttatgactgactcacttcacgcagcataatgtcctcaaggtccatccatgttgtagcatgtgttagagtttccttcctttttaaagctgaataccactctatagtatgaatataccacattttatttatccattcatccatcagtgggcacctgggttgcttccaccttttggctattgcgaatatcgccgctatgaaattgggtgtacaaatacatctttatatccctgctttctagtgattcactcttacatgtgaacagataactaaggatcagaggactttttaggaaaacttcccaacgttaaagacagaaaccaaaataaataaggaggaagggctcttgaaaattaaaatggtataggccaggagcagtgactcacgcctgtaatccgagtactgtgggggaccaaggcgggtgggttgtttgagctcaggagtcccagaccagcctgggcaatgtggcgaaaccccatcattacaaaaaattacaaaaaaattagccaggtgtggcggcacatgcctgtagttccagctactcgggaggctgagatgggaggatcacctaagcctggggaggtcgaggctgcagtaagctgagattgtgccactgcactcctgcctgggtgacagagtgagaacatatctcaaaaaaaaaaagtataaataaaaaaggttagatgggttggaaaataaagtcatagaactttcccagcaaatagcgtaaaaagagagatcaaacatagtagagaaaagataataatcaatgaagatggtccaacagcaaatttataggatttctagagagaagaaaggtgtttatcaaataaactacgggagatatttcctcccaaaacgatattggtatccacattcaaagggccttccaagaggcttgcaaagatgaaaatagaccatacaaggcacatcgtggtgaaatgtcaccatgccgggaataaagacgctaaaaccttccagagcaaaaagcaggtcatgcaaaggtttgggacacagaatagtatcaaaggtctcaatagcaacattcagatgctagagtagaacaatgtttttcaaattcagagaacaataccttttaagctagaattctgtacctaagcaaatcatgaatcaaaaaagaggcaaacaaggtctccatcagaggagaggagcagaaaagtcccaggaacaggggcagcaggcccagagggcattaggttggtgggcacaagggcacaggagatgaaagcttctggcctcacactatgggtctgtagctttgtttctgattgattcatgcagtcatacaacagtgttttttgtctattatgtatcaggcactcttcccttctaagtgctgggaacagaggtgaaaaaaacaaaagttcctgtcctggtgcagttttcattctaaggcgggagagggacgataaacaaatataccttgttaggtaatgtcctatgaggaaaataagcagggaaaagggatagggtgtaaccaggtggagtgctagactggaaagaccagaggtgaccttggagacctgagtgcagtgagggagagagccctgggcattttgggggtctggagagagagctcttaggcagagggacttcaggaccagctgccctcatcagcctggcctcctgacaggcattctccaatggacaagattttctcttgctcccagcctgttcatttcttctggaccctctgggaaacaactctgcctggaggcagatggcagggctaagcagccccaattaccacatggctggggccctattgggccagtcctctttccccttcccagtgggggagatgacacaagactctgcaagagagatgggaccccagaagacagaaaggatgcaagtggttgagtgctaaggtggtaagtccaggccctgaagccatctaggcagacacaacatctgacacttacactgctctttctgtgcattttcacaagcaagagaggcagaacaggtaccaccatcatgcacagatgccgaaactggggcactgccaggtaaggaacctgcccagggtcacagagcctgttagttacagtacgaactctcactggggcctgcttcagagaccagtgctaggtcaaaaccaaacgtaaacatgtttttcttgttacttttcatgttttccatacaggtaaaaataaagcccaagttgtaagtggttcatgagaacagaagatctttttatttagcatttcacaaaatataaggctactcctcttgagacttcaccttgagctgtaattttctagctacccatgggtcagagacaggcactagaacttggttagacttactccacctcagattaggagcaattaccgtttgggaaaagaaaagcaaactgaaggatggaacagtctacctagaagatgtttcaatgatcggataactagcattatgactagttccccgccagaatatgccgcctcagccttcccttccaaacgctgcaatctcctttccgttacctatcttcggggttgcagttttgttctaagagcagaggagcatttgcatctgcggggcgaaggtgctgagtgggaggagcggccactgcatgcccacagaggaagctgctgtgacagccctgctgctcctgctgagcaagggaactagagtggcccagtctccacctgggtctggctccgttcccgaagctgattcaggaattgagtcatcattcgcaacctgaagtcaaggaacatcttaattagatttaaaacactgtatttcaataatatctaacagtttaaaaatacccccacatttaaccctcagcattcctgcgtgagggaaacacagtggtgcctgcaatttacttgaaatgagtaaaacatgtgaaatggacagatggatggatcggcagatacgtgataaaacaaagtaaaagaataaaggtagaattcaggtattggatatatgagcgttccctgtaaaattctttcagctttgttgtagttttgaaatcttcataataaaatgtcagggagagtgggagggagggactctcccatcatcctggattatttcaatatccatgtgaatgattaattcaacaacccagcctcaagcttcctggccctctgaatgccggcactctcccgtcacctcctggaccttacctcacttaaaacagtcctgccttgatcttaaactatctcttcagaccagattcctttcattccagctcactgcctcataggtgcttccgcttcaggaaggtatctacacctaaaccctccatttccccgtgacttctggtgcttctgtatccaacagagatttatcagccccctcagcaccttccctgcaaacctgcagggccagccactgtcagggaagaggaacacaggggcaggaaacaacctcacagcccctgcctgcagcaagctcatctggagctgagagtagggacggaggagatgtgtgggcacagctctcacggggctttgctgccatggttcctgtgggcttgcctgtgcttctctcccctgctggatcccctcttttccaccgctgcatcttcccggatagctcagtttactctcattttgatggatcatatttttcaacagcttaaacagtttttattatgaagtattttaaacataatcaaaagaagagagaatggtataatgaacccacatatacccattctcaacagtaacaagagtctggcatatttgcttcattatcccattttttttctttttctttctttcttttttttttctccatgacggagttttgctctcgttgcccaggctggagtacaatggcgcgatctcggctcattgcaacctccgcctcctgggttcaggtgattctcctgcctgagcctcccgagtagctgggattacaggcatgcaccaccccgcccagctaatttttccatgtttttagtagagacggggtttcaccatgttgatcaggccggtctcaaactcctgaccttagatgatccatccgccctaggctcccaaagtgtcgggattacaggtgtgagccaccgcacccggactttttcttttcattctttgctcaagtattttaaaggaactcagacttcttcagtgtgcctctcttaaactccaggcctgtaatcccagcactttgggaggctgaggtgagagaactgcttgagtctaggagtttgagaccagcctggtcaacatagtgaggtcatgtctctacagaaaatttttaatctgttttcaaatgtatttgcagagttgtgcaaattaaaatataagaaattaatgcaaaggtcagctaaagttgctgtctattaatttgatatttagtagttttcatttgtaaattaactaactcttagactgcaaataaacatttttgtaaagggctatgtttttaagtttctaagaaaatcttcagttagcagtttagagtcttctaaaattaaagtagaaagaaataattggtgtgaaaatgcaagggttagctgtgttagaaaatgtctaattgagggttgtaagtttcttctatcttgagaagaataaatattttgaagagtaacattgaaggtggcatgtttaaaagaaattaaatggttattataaaccacaggaaaaatagtagaaaggaaatggtaacagaacaatcaaagaaaagcataatgggataataaacaggttaacagtgtaataatgataattaacagtaacaagatattgttaaaattttaattaaacttaaagcagcagcaggaaatactgaaaaataaaatacttggctacataaaaatgtacacttctacttacttctaaccttataaattctaaaagaaaaaacacaaatggtaaaacacatatgaaaaaactgtttaatctgaacagtgcaaaaaatgctaacaataacactaatgaacaatttttcacactgcaaatcaccacagattaagaagactgacatttttagtgtgatgaagacaagttccttccagcttttgggaaggcagagtggcactctgtgtcaaaatgtaaactgaccataccccttcacccaccaaatctatttctagaaattcacccacaaaagacaatcacataaatgttcaaagatctatctattgaagcagttttcaaaagagtgaagattaggaaagacttatccactaataatggatagggtaaataaacaggtacattcacaaaaatgactactgctacagtcactgaaaatgtaaggatgctggagaaagtcacataataaagaaaatcagtgccactataattcatgatcactgctcccaaatgggtcctcaattccctttctctaaccgcagactcacaggcccttctgctgatgtgatataagctctcctatcagcaataaacaggaatgaagtattgatacatgctacaacatggatgaaccttaaaaacagcatgcaaagtcaaagaccagacacaaaggaccatatattatatgattctatttacatggaatatcccaaataggaaaatctataaagacagtagattagtggttgcagacttgggatggaggtagtagggggtgacagctggtaatgaaaatactctaaacatgactgtggtgatggatgcatattcaactctatgcatgtagtagtatattcaactctgtgaatataatacaagccactgaattgtacactttaaatgagtgcattgtatggcatttaaattctctcaataaagctgttaaaaaccaaaagctctcccatatgtggaatgtttgcgtgacccctgccacctgagtaccctcatgcttacagctaaacatgcctatgtgttattctaatgtgtgtgagtttcaccactggcatgcaacaaatcagctctatattcatttgttactccacctttctaaaaagctatctgacatattgacagtacataatgacagctaaaatttcttatcctttaattcagaggtgatctttttgaaacctttaataaggaaatacaaaaactaaatctgtcacccaaactggagttcagtggcacaatcactgctcacttcagcctcaacctctctgggctcaaatgatcctcccacctcagtctcccaagtagctgagactacaggcacacgccaccacacctagctaatttttgtagagacagggttttgccatgttcctcaggctggtctcaaaactctgagatgggctcaagtgatctgcccatctcggcctcccaacatgctgggattacacggatgagccaccatgctcagccaataatttttataattggaaaaaactgcaaaaaatctaaatgtttaacagtagaagaatcaataaaccataatatgcccatacaagagatagcaaaaagacattaaaatgttttcaaagaatatgaactatagagtgttcatgatgtataagtgaataaagcagaacataaaagtgtatatataatgtgatcccttttatgtatattatacatttctacaacaacatggatgtgggagcacctactgccttctctgaataccatccctttccttgagagccactgtcttggtgtaatgtgaccacactgcctagtctcaggagcaggggctaatctggggatggggtgggctaatgacaggctctttcccagaaatctcagccatgagattcaacttggttgctctcctaaacggagatcttaaccctagggccggtttgcaagtcggctgcagttagctgttatctaaggaatgctgggaatgctggtaggggctaggcccacggggcagctctgactcctccccatagtcccagtgcttaaattccaaggtacttagcttttgctgaaatgctggggcaggaagtctcccagaatgcagtggctgtgaacagcaaggctaatcccatgggaatggtggctgtgtctacctgtgccagcagttccctgtagcatcttcttgttgaacccactccagtcacaggaaataatcagagagctgattatgctatgcaaacaaccaggggttgtggcagtctacaatttccaaccacttgtctaaagcgtgattcagaggggcagcaaccagtcctggtcaccacaagctgttacactttctgcaggctgggtatgcaaaatttacctttctttcagaatatactgtataattttacttggaattcttattctactctcacagcatgttccagatgtcacacagcatgaggaagcaagtgctctccagcccaggatctgatagcacccacatctttgaggactgaggacagagggcatcaggaagccctgacaactctggcacatctgccaccaggtgtgtggtgaggtcatgagggcagacactcaggcgctactcctcttcttctcctggttactcaagaaagctactcagtacttccatacctgagtttcctcatcttcaaaagggaggttacaccctctaagccgtggcattcaccaagaggctgggacattattcttagaaatacacaaatacacgcacccttttttctagtatgggctgttcttaaaggtatgtgtcacactgagtcagcaggctcctgggtccataggcaggtcagcagtctctgacacattctccttcagctcttctgacaggtagaccttccatttttacagctttatggaaggatatttcacagaccataaaattcaacactgaaagggtaaagttcaacgcttttcattattgacacaagcagatcttgactgtcacagagagaaagataaaaaacatattagctcctttctctagtggcctgcatcctctgttccctgccatctcttaatctttccctccaataatgtttgcctgggcatcccctctaacccacagccactttcagacccctcagcagcacctcctggtggccagcaagccttggagggagggagccgccagctagtgcagcagttagctcaccatgccaggacccacactccccccagtggaataagctctatgctcagacaacagacttaatgaaaaccaaagaaacaaggataaaaatgaggtgaaagaaatagaagtgtttttgtgaacttttaaagtacagtaaataagtctagagtttataagcaaaagctgatatttttttaaaagagctttactgcataatctttatccttattcccacaagcagtcaaaaatcccacaaccacatgaacctatcaaatagtaaagaagcatttgggaacaagagctaggcgcagaagctcacacttgcaatcttagcactttgggagaccgaggcaggtggatcacctgaggtcaggagttcaagaccagtctggccgacatggtgaaaccgtctctacaaaaaaatgcaacaaattaaccggacatagtggagcatgcctgtaatctcagctactcgggaggctgaggcaggagaattgcttgaacccgggaggtggaggatgcagtgagccaagactgcgccattgcactccagcctgggtaacaagagcaaaactccatttcagaaaaaaaaaaaaaaaagtatttggggacaagaaatgaattaatatgtgtgacggacaatgacttaataatacctaatctggttctactttcttcatcttgatttctacttttgattgcttcttattgtaaggaatattttcaagacatattttctgtttctcatttatttttcactggtcatattttctaatcctgtcttcactttggtgtcttctctggattttagtagtgaaaatgactgacacgttttgaaataaatgttaaaaagataaaaagaaaaactcttgcctgaaaaattaccctagtattcaagctacttgtgtaaattacagaaatttaaaaaaactctagataatataattatcagatagaagttctacaatgagtacatttgaaattattaaagacccaaagaaataaaaatcccagggaacaaaaggtaaatacaaagcatagaaaaacatgatagtgaggtgggtgcatcacctgaggtcaagagttcaagaccagcttggccaacatggtgaaaccccatctgtactaaaaatacaaaaattagctaggcgtggtggcgcatgcctgtaatcccagctattcaggaggctgaggcaggagaatcgtttgaacctgggaggcagaggttgcagtgagctgagatcacagcactgcactccagcctgggtgacaaagcaagactctgcctcaaaaaaaggaaggaaagaaaaatatgatagaaatatatccaagtacatcataaatcacaagtataaataaataaaatgtgtccacttaactggatgaaaatttagaccatgtaaaaagaaaagtaaaccccacaaaatccatagagacacatgcagatacacagaggttaagagaaaaagaggaaaaaataaatatactggaggaatttagattctgagactgaaggatgagataattcagattaactccccctctgaacacaactggaaaaaatataaaggatattttcttgaaggcattatagaatcaagaagatggtaaagaatggccaagccaagatactggaagaatggaggtctgagaaggtgagccacgcatatggggccatcttccccttggggcaccttctgattctggagagcatcgctgagcaacaaggactccatccagggctgaaggcacataaattggaatccaaggcccccgaaagccagggagcttggttaatttggactgggatcctgaaggggtactctttaaaagcaaagaccaaccagaagttggcaggccctcataggcactgcagcttagttctgaatcatttcagtccttgaaatcggactgatgttaacccagattgctactgctgccaagtgcccaccagaaacaaacacaaacccatctcggaggagaaatatctatcatcctagacctcaatttatttttacattttttcaatctttagataactcaatcaaaaataaccaggcatacaaacaggcaagattatatagaaaaaaaaaaccactagtagacaccacaagcaacagaaacatacccacaattgctctagatttagagcaaaagaactatgtttactatattcaacaagataaaagatgagattgttttggcagagaactgtaaaccaaaagacgaaccaataaacatgcagagaggctcaatatcattagtagttagggagatgcatattaaaactaaaataaactactagtacatcccaactatgatggttaaaaatttttttaagtgacaacgacaagtgttgctaaatatattgagtaattctcataagctgctggtacaactataaattgtttaagccattttagaactgttcggcaatatctaataaaactgaacatatgtgtaacctatgatgcagtgactctatggcaaggttatacatccaacagaaactcatgcacatctacatcaagagacatagacaagataactcctactcgcaaaatctgatcactagaaggaaaaatagataatcttactctcacaatagtagagttaaaacacacacttgtcggccgggcacggtggctcacgcctgtaatcccagcactttgggaggccaaggcgggcagatcacgaggtcaggagatcgagaccatcctggctaacacggtgaaaccccgtctctactaaaaatacaaaaattagctgggcgtggtggtgggcgcctgtagtcccagctactcgggaggctgagacaggagaatggcgtgaacccaggaggcggagcttgcagtgagccgagatctcgccattgcactccagcctgggcgacagaatgagactccatctcaaaaaaaaaccaaaacaaaacacacacacacttgtctcaataaactaattgatcaagtagagagaagctgaataacaaccaataaacccaatctaaaggaaatatgtagatccaactagagaacccattattttcaactccacagtcattaaagaaaaagaaaaaatgcaaatttcaacaatgatcaaagaatctttatcatacaatttacattatttaaacccaataaaatcagaaatcaaggacaaaaaaaaatcttggaaatttatggacacagttttaaaaaatcataggtcagagatgaaaccataaaggatattaggaaatacttacaactttaatgacaatgaaagcactaactattgaaatatatgggattcagctaaaccactacttagagagaaatgtagagttttacgtgtgtattagaaaagaagaaagcctgaaaaccaataatttaaatgtatgactcgggctgagtgctgtggctcaggcctgtagtcccagctctttgggaggccgggggaagtggatgacatgaggtcagaagtttgataccagcctggccaacacggcaaaaccccatgtctactaaaaatacaaaagttagctgggtgtggcggtgaatgtctgtaattctagctactcaggaggctgaggcagaagaatcacttgaaccagggaggtggcggttgcagtgagctaagatggcgccactgcactccagcctgggtgacagggcgaaactctgtctcaaaataaaattaaaaataaataaataaataaatgtatgactcaagaagtcagaaaaagaacaagagtataagataacaggggcagaaattaatgaaacttgaaacaaaaaaaaaatcctgatttttaaaacagcagcaaaactgaaagctgcctttttgaaaagactacaggaaaatagagaaggcataaataggaatgaaaaaatgattacaactacagatacagctgacatttttgaaaaagaatactatgaacaactttatgcaatacaactgaaaatttagggaaaagtggacaattccaaaaataagtaacattaaaattcagtcaagaagaaatgtaaaacttgaacaaacctactaaagaaattgatccagtagttaaaaacctattccctcaaaataaactaaaaataaacaaataaaaccctggacacctgccctagatggtattatcagcaaatcatatcaaacattcaaaatgcagataatctctatttacacagactattacagatgacagaaaaagaaattattcccaactcatataatgaagctaagaaaacccaaaaaccaagccaaacaagtacagcatgaacatctcacttactaacagattttaaaaacctaaataaaatgttagaaaatacaattttacaaaatcttaggcaacaccattgtcaagtacaagttatccaagtaacacaaaacaatatcatactagaaaatactttagtatgattatttaattcatcacattgacagactaaaggagaaaaactgcattatcatcttaacaggtacaggaaaatcactctttaaaattcaacactcattcctgatacaaacacctggcaaaccaagaccaacagaggatttctctaacctgataaagactacctacaaaaacatacagcaaatatcatacttactgatgagacattagaagcagtccctttaaaatctggactaagataagggtgcccactatcaatcacagcctccattcaatactgtgctgaagtgcctgacatggaagtaagacaaaaaggactggcgtaaggattggaaaggaagaggcaagtctgtcataatgtgcagagaataggaaagtctacacagaataactaagaaaatctataagttattagaattaaaatgaaaggttcctggttataacctgaaaatacaatagtcagttacatgtctagacatgagcataaaaataaaaatatacagctgacacttgaacaatgtgagcgttaggagtgctgaccttcatgcagtcaaaaacccacctataactcctgactccccccagaacttaactactaatagcctcctgttgaccagaagccttaccaataacgtaaatagtcgattaacacatattttgtatgttatatgtatataccgtattcttacaataaactagaggaaagaaaatgttgttaaaaaaatcatatagaagagaaaatatagttactgttcattaagtggaagtggatcatataaaggtcttcattcttgttgacttcacattgagtaggctgcagaggaggaggaagaggaggggttgatcctgctgtctcaggggtggcagaggcagaagaaaatctgcatataagtggagccgcactgttcaaacccatatggttcaagggtcaactgtaagtcatgtacaacagcaaaaaaactatataacaaatcaaactagtcacacaacataaagttttattgaaagtaattttagaagaatagagagatgtactctattcacatataacgagtccaaattataaagttattaattttccccattctaattctatatgttcaatgtaattccaaactcctgctagggttttctgtgtggaatctgacagattgataattataaaatgtataaagaagatcaaagagccaagtacaaccaaggcaactttcaagaaccgcctaaggtgggaaagtacttgccctactgttagaggaaaggagtcccgatccagaccccaagagagggttcttggatctcacacaagaaagaattcaggtgagtccgtaaagtgaaaacaagtttattaggaaagtaaaggaataaaagaacggctactctatagacagagcagccccaagggctgctggttgcccatttttatggttacttcttgaatatatgctaaacaaggggtggattattcatgcctaccctttttacaccatgtagggtaacttcctgatgttgctatggcatctgtaaattgtcatggtgctggtgggagtgtagtagtgaggaccaccagaagtcactcttgtgaccatcttggttttggtgggatttagcggcttctttactgcaacctgttttatcagcaaggtctttatgacctgtatcttgtgctgtctcctgtctcatcctgtgacttagaatgctttaaccgtctgggaatgcagcccagtaaatctcagcctcattttacccagcctctattcaagatggagttgctctggttcacacgtctctgacaataccagctttcaagatttgttatacaattatagtaactaagacaggtttctacacagggagaggtaaacagaccaagggaaaataagagagaaacaaatccacacatatatggaaacctggcatttgacagacatggtattatagatcagtatggaaaggatgaaacacccaatatatggtgctgagacaactggtaatccacattgaaaataacaaagcaatctctacttcttgccacatccaaaaactaaatttcagaataaaagactcaaatgtaaaaagcaaactttaaaactttaaaaaaaatatgggagaacatctttatgacctggaaaaaaaagggttttttaaaacaagacattaaaataaaagaaaccataaaagactgataaaatgactacattaaaattatgagcgagaagcagaaaataaaaggtaaaattactgacaagaagacatttccagtgtatattaccatcaaaggactaataacagaatacacaaagaactcctacaaatcaacaatcttctctccaaacaactattttcaaaagtatgaaaagcctccatttttgttttcattttgaaaaatgaattatttaggctcactgaaaatattcttttccttattgtaatttctaacacagaattctaacactgattttgaatagtattagaactattgaaaacaatttaatgattaatacatttgaactgtttttatgattataaaataatgtgtaactatgaattttgtaaagatatcaaaatacacatttgaaatatttaattaaaatgttaaaattaaaaagaaacaaatgtaaagagcataaaaatcattaaaaatccctcatgcatcacacacacacattttgtcaatattttggattttttctttactttgtttctattaataaatacatatacatagatgcacaacaagctgggtccaaagtgagggtggcttattcaagtgatgacatccatcagtcagtagatgatgcaagctaatgcttaggaaagaggtgaggtctggggatgttgacttgggaggtcatgcttagagcaataaaagttaagactcagtcttggatgaagagattgtaggaagaaaataagagtgaggacacaatattagaataaggagcagaataatatgttgggaaaaataacttgaaaaaagagaaagtacaattagataggtaggaggagaatcaggatattgtggaagaatgtcaagaagaagataacattcaactgccaatcctgaaaagaagttaaggagaatgaatcctaagaaaaggccaacatatttaacaattgagagagacggctgtggagtaaacgtctgattacaggaatgcaaagaaaacagattgaagggatagggatatgtgcatatttacaccacacagtcaacaaatctggccagaaagaaaggtggcaaatcaagctttttttcaagatattagagatctgttatctgtctaccttctctgggcgagaagcccagtatactgaaagactaaagatgctgggaagagagaagtaaacaaaaacacaaatgcctgaaagcagagggagaggatggactttaaaagagttctggatcatgacttgtcatctgacacaggagaaaagaaccggggtcacaacagacatagttcaagctgaagaggacaggagaaacctctggctaggtaaacttagtaattttagtaccaaggtacgtcacgggacaaaactcaacttaaatcaagaagcatccacactaaactatacctaagggcttataagagacgaaaaaaaatccctcattatgtctttgcttcaactcacccatgacatgagaaccaatactggtatttgggtgaagcttcaaaacaactgaaactatggggaatgtttcaaaccagttaagcactgacataaatgactgagaaactccggtttccttaaaataagcaaaatattcatttgttttgatattattttttgatgatacaagtgtccatctgtagtagctagtcaataaatattggttcatgctacctgtactgaatgtttctgtgctacatggtcaattgcataattgccagtttaaggtacagcattaagagcaaaacaattcacggtgaaataccccacccatgttttcctacacatctgtgattcaacaaggaatgtaatgattcacagtattggcattaagtttatattgaggttgcccttttgtaactgagaagtagggctgggttgtcactgtgatcttcccaatcccttccacatccaaaccctcacttcccttctcagccccactttgaatgacgccaagttaaaacactaatgtagacatcctctgtcataaagccaacaaaccagagaaacaagaatgcttattgacctccttccttaactacttcttaaaaagggatctaaaatttatgagtaataaaattctaaaaagaacatttaccttctatgtgtatgcataactaaagcctacaactgaaatatttggaacttctaaagtagttttcaacttcaaatacaaacttatattagagacaaaagccattagctttgctatgagtagtgtgaagggttgatgtgacttgaggaagcaaagtttgcaaagattttcatttgactgtagatttacaaaatgtttaacaatttcagttcctgaaatagtcaatataggttaaaataaattagtaagttaaatgtggaagtctttaaggtaataacaaagcaaggccatcagagggaaactgagaattatctctctcaaatatctggagagtgactgtcaaaatcaagtcacaaagaaattactacattcacattattccgtgttccacagatgtttcttctattgctcacatgaactcttttctctttgctttcacactcaccagtaacacttgtagatctcctaggtcatttgaacatttagcattcaactctttgatcagttcaaactgcctccacagaacatctttttctttcaagcgttccttattctcaaaatgttccttgaatttcaaccaaatttaaattccttacatttaccttctaaactttgtattcacctcctctgttccaataaacaggaacaactctctaagcccttgtgtcttgtagcaaccattgccaggcattttcttaaaattcttacacctcccttgaggtgctggtagctttagaaatgtcgccggagcagcatgaaattagccatgactaggacaggacagtcaggaattgctgaagactctcatgcctgcttcaccacctatggtcattacaaaggacttcaaaattcctggcttttccagtcctggaatgaccctgatccctgccccattcctatagcacaatcccaaaaccatacatggtctttctcaccacagttcccctgccaatctcttaaatgctcacatctaatgcttaggccaaggctcttgtgttgcacaagaggtcccctacacccccgttcctgctgacttcacctccttgcatcaacaatctggtctcctgggccatcatttcaatcaccctctcacctttaatcacaactatttccttcctttgtctttctccacataccacccttcaaaaccagcagtgccagctctccactgccacccccaggcagatgtgctttgctggagagagtgacaccagactggccctggtacagtcctcaacatgttcctagccagggttccctctccttttctggtcctcagcagcaatcctacatcatcacctctctgtagcatccccaccttctccctcttcctcaactggcaatctcaatgcccactcagggaatgaaactacctcccaaccccaaactggtctctatatgagttccctcctcgctgggggtttcctccctcctatgcgctagagtccatccatctgtcccatccctacagcaccagggccctccattctccctttccctctggtatcttcgaagactctccacagccatctaaagatactcaacactctcccacttaaaaaaaatggcacatgttaaaaattaaagacttctatagagaacattaacacgccactaaatactgaatagagtcgtccagtcagtcttcatcatctagctcctctatgttgccagcacctgtcagtgcctgccttccccggtccagcctgttgtagacattgtgctcattccttgtttcttgtttcttcagccccagaaccttcctaagccatcctgaccaagcctttgggcttcctgtgtctgcatctacagggccacccgccggctctccaaactgaggctttcttccccacatctgcagttctgattgctcaactcttggcttggtttcagattagtactccaggtgctgcagtctgactaaactcccacttactgcactcatgtccaatcagtgtcctgacaagacaccagctccttttccctgggggtacaaaccttatctcaatcccgcaaattattaggggtccccgtgctcccaaattcatgtcactaccactaactagtggaatgaagtactgttattgcttacagaccgctctactgggttcataagatccaccttgggtttatcaagttcccttagaaaatatatttagaacgctggcagcccagtggagtccagctacacagctcggcgcgtttaccctgggatcccttgtttcttgtttcctttcatttccttctccaaccaatttcccatcatacctatgggcaaacacccatgttataacaagcaattcattaactacttattttaagttatggtgaagtgttataaccataatatttataagtgttatgaaatttataagttctgaaatttacacaattctttcagtggttagcaaaccatactactattatagactctattatatttcataaccacatattatacacaacatgagaagatctctgtttaagagtcccacctatggtatttgtaaaaccattcaatcaggcaaaaacaaattaaaaaagtaatatcagatagtaatacactagaaaaccaaaccttgaacaaacatttggggatccccaggcttacaaatgtattggtttctattgggtaaagtcttggctttctcattttatatcatttaaacaaaggaactgaaaattatattttaaaataaaaaccataatctaaaactaatctaagaaaatactgagaaaaaatagcagtaaatttatatattttatcttctgtaatgaaaactaaggggaaaaaggcatgctaaaagcaactagttctaaagtaacttcatgaatgtaccacacagaatacttaacagctttaaaaagcagttatgaaatgcccatttgaacatcagatgccacggacagaacaagtatccaacctaaagcagacaacacggacccactcaaagatatgcagtgacatgcagagtcgtacttcacacaatcctcatttggagaatgagtcaagaagggcagcagcgcgaccctccaggcttttccaaaatgaccctcctgataactgaggagctccagctgggctgttcttttgccctggttcaaaatatacctagatgtggaaaagtacaaaggcaagcatttcccatccactagaaaagaagttcaattatcaaatgctaaatctaggttacactaaaaaaaattagatgaattaaaatgtggcctgcctcaaagcaagagcatgtcttaccaatcttactgtatctcacttaacatactcaagaggaaaagaaattgaagcatttaagtagtccatcttcaacattctgctgtgaatacaggacctgtaatatgcttgttctacttgacatataaaaagaatcacatttatgtggaagcctaaggttaaaacaggtttttaaaatgtaaacagcagtaacatgaatgtattgaattacgtaaatcccaaaacttttcatgccacaatggtatgggaaggtcggtgactgactcacctaaataaaatgcagtaagtcaaagtatatagttagagcaaaaggaaaaagataaaaacattttaaaaactaatttatggttttaattctctataataaatcttttaaaaattaatacacagtagaaaatggagaaacaaagttaataaatgcttacaaagatggcttatgttatattaaacatgaaaatgatatcaaagcataattatgaaatcgtcaaaaatcacgtttgtagtacaagtttacagctagttttaaacaaagaattttgaccaattacttgcagaaagtaaacaagaaaaaaagcttgacttctttctgacagcacggaagtccttataaaacagagcactatgtcattcgactaccaccccccagttatcacagttcttggtatataaatcaccttcgaataagcacagggtgtctgaaatttccactctgccctaagtaacaccattcaaaatatcaattgcttccagcaattcgaacaatgaaaataactttaaattggaaagattatcccactttcatctccacattaaagtccatccatcataaatttaagtagagttatggtgggcaagacgtagcaagaatgaaataaagtattttaaccacaagagacccaaacaggacttggcaacgcttcctaactgcacacgctagaaagccctgcccccatgtggctgaaagtcttgcacagctggccagcttgccctggggcataagggagaaggttcatccccgaaattgccatgttaaatgcccacttctggctgttggaagatttaggataccatctactaagcagaaaggatacctttttcccaggctcagtgtcttggacaatgtgaacacacaactaataactgctggattatggagacaacagcttgtgtctgcataatgccttatgtaaggttccctcccacggatgcagcaaacacggaacattcaagttctgagatgatgctgaggctcaatttaaatggcatctttcctgctctcaactctactttcctggtaatgcttcatgacatacgatcttttagtcattattcctaaataatagtgccctgtcagtactgggggcaaaggacgcatcttggcacttggagcttttgctattctctctccacctggtacacactctgcagtctgtgaccctccatttccacctccagctgcctggagtctctctgcgaatgcttcaattccctctggttcacagcccaaaccagagcctacacctgatttaccattagccatttcccaagcctgtactctgctccccaacccctagcacaggctcagtgactctgaaggtgaaagctggcagcaatgctggtgagtcataagagaaggcaaggaaaaataccacccagctacacaccatgtgctatggtcagaatgtctgcatcctccaaaattcatttgttgaaatcctaaccacaaaagtgatggtattaggaggtggggcctttgggaggtgattaggtgctgggctggagccctcatgaatgggattagtgcccttacaaaaaaggcctaagagagcttgtttgccctttcaccatgtgaggactcaatgagatgatgtctgtctaccaggaagtgggcctccccagacaccaaatctgcgatggcctgatcttggtcatcccagactccagaaccatgagaaataaacttctgttgtttataaccccccaaccccccagtttatgatattatgttatagcaggcaaaaagcattaagacaccatgcacttgaataacaaactctggaaatagagccactgtcaagcctattagtgactctcattgtgagacttccagaataagcaggccgtaagatattctgggggaagactgggtggggtttatgacagcatccaagtcaggttcggaggaatgggccttcctctaacctacaaagtcataactagaaagaacttaactatagcattcacttctccacctgccataggaaagaaaagagtaaatcataggggagacaaagtgattcctttcctcttggtttataaagcctgcccagagccagcacacagagcgtgtgcccatgtcacaggtggccctccccttctgcaccaggtacacagtcaggcctcacgaaacattagctactacaaaatgtaggacttacccaaaaaagaacatgtgtagagatagaaaacaacatattctgaaatgtccatttttcattctaatgctcagcagtcatataataaccagatgaactaagctgctttcatttagacttttgggaacagaatggtatctgtttcaagacaaatacaaccaattttctatctatacttgaaattacgtgtgtgtgcatacagacagattcactatgttatttatatgttcctcagggatgatttactgttccataacaaacgtggtgatcaaatgattctaatcactgactgaaaagtaatgaaataatctaagatcatctctgaaaagctgaagcagatccatattagataaaaaagaatgacttccataaatcgactcattcaacacacaggaaagcattctatctttatatttctgtatttttcaacctcctctggcctgcttgccaccccactgcccatggcctatgtcaccaatcacctccaagtgacccccaccctcgcccctgccccgatgaccaccataaccacagcacccagagatgagtccactgcactgtgccactttcacagatgggggaggaagagagctgtaactgtcagaaatacatgaaaactgtcaaaaatacatgccatcagctctggagattttgaagcactgatgtctctctgttctgtgaatgtattaaaaaaaaattacattatccctcctttcaaggttagcaaaaataaaagatgaactctacttccacctctgcaaatgacctcctacgaccgcaggcaggcccacgctgcctttgccttccccacctgcttgaggccacacacatctccgtggaccactcctcccttccagaaactcccctgttcgcttcttcagcctctacccaggagtttcctttgctggcccctcgccttctgactgcctatgcactggtgaggttccctggccctgccttagtcctctctctgttcacaaaaccatcctagcagtaaaatcctttttcccaaataaaatggtctgtgctcctcaccctccagtagaacagataaaagcagagctactctggctgaaggggggaaggaggcttgaggccaccctcatggggcatctctacagacctctagggttgggaaccaccagcagtttccttcaaccagctggtgtgagctccatctccggtcccccctctgccccctcaacacctccccactttttgcccaacaaagtcatatgagtccttccagatccagtttcccagccaccttgtttgtgattctttatgtacaaagtagctttgagcacttcgttatcccccaaggcactctgcaccgcctccaccattgtacacgtatcacgtgtttgtttacatttttgccggctccactagattgtgaccattttaaaggcagacaagatgatgacaatggcgtgcatgcgtgtatgtgtttgcatgtgatgggacaggggagtctcagatgaacctaaagttaggcttaaactgctctgggtgtgaggctggtgcactggtctgcatgaagaggccgtgaggagggaagcgactggagaaatggggaggagaggtggctgcggtctccatgcccgcccaccagagctgcgtctcagccctagacagagagggtcaagcaaaatccaggaactgctttcatgagagacttcacaaaatatttgttaaaccagaatactgaacgcataatattctcttctttgaaataacattttctctattcttttcattaagacccaaatttctaaaaggcctatattttcttctcagttctgatgaataaaattctgcctaaagtcagagtcaataagctcccgaactagcagttgctaatgaaaagaaactctgaagagatgagagatgatggcacaggtcaactggaatggagacaaaatactgagctgcaaaaccgatccagaaagcccactaggtggagatgaaggccggtaccactcacaagaatggagtctttgcagcctttgtacttacaaccattttttaaaacaagagttcttgcaaggttgtctagaagactcctttagaaatatctgaacattcacagtttaatcaagaaagtatccattaagggcaaaaatctcctaccaattagttgtcaattggcaaactgcattcagactggcctctggaactcccaaagttataaaaatagctggattcctttttctgcaaaagagcctcaagtctctctgactcctctccgtttggaagattaataacggtgataattctggaagactcctttaccacacagcggtgcgtacctccgcagagggctggcagtgggccacagcacactctgatgtcccgtgcagttcactgacacccaggttagcaacacaggctgtatgctcagtgaactggggctggcaagggcaggcccggggggacctgcaagggaggggacttgttcataagcacctataagaaccaactcccaagtcatttttcttttcttccttttttttaagtgaatactctctgtattttggttaatcaacaatctttagcacccattatggacaaaacaatatgctgcacacataccaaggatacaagaaggaacaaactaccctggcctgtgctctgatggagcgcactttctcctggagacagatgaaagaataaataaaataactgcaagctgtgataagacactggtgaaaccaagaccaccagctcaccaagtaacactagaagatcgccacaagggattttatatgtgtaagagagagagcgggtgggcatcctcttttgacataaaagatgatggagaaggtcttttttaaaacatgcattcagtcaaatccatgaatttagctaatccttctttccctaagtgtgcaattagggaaaacctaatgactactttacaagttatagttttggcttcttttgctatttattaaaaacacagccaggcacagtggctcacgcctgtaatcccagcactttgggaggccgaggcgggtggatcatgaggtcaggagtttgagactagcctggccaacatggtgaaacctcgtctctactgaaaacacaaaaattagctgggcatggtggcgtgcgcctgtaatctcagctactcaggaggctgaggcaggagaattgctggaactgggaggtggatgttgcagtgagctgagattgtgccactgcattccagcccaggctgacaacagtgagactccatctcaaaaaaaaaaaaaaaaaaaaaaaaaggcaatattttcaggccaagcatggtggcttatgcctgtaatcctagcactttgggaggccaaggtgggcagatcatctgaggtcaggagtttgagaccagcctggccaaaatggtgaaaccccgtctctactaaaaatacaaaaattactgggtatggtggcgcgcgcctgtagtcctagctactcaggaggctgagggaggagaattgcttgaacccagcaggcagaggttgcagtgagccaagattgtgccactgcactccagcctaggtgacggagcgagactccatctaaaacaaaacacacacacaaaactaaataagactaaacaaaaattttctacctgttaaggtacttaaaggaaatattttgtatgtaaaaattaaaaatcgttagaaaacaggtacttgactttaaatttatttatttatttatttatttattttatttatttttgagacagagtcttgctcagttgcctaggctggagtgcagtggtgcaatcttggctcactgcaagctccgcctcccgggttcatgccactctcctgcctctgcctcccgactagctgggattacaggcgcccgccaccacacccggctaatttttttttgtatttttagtagagacggggtttcaccatgttacccaggatggtctcgacctcctgacctcgtgatccacccgccttggcctcccaaagtgctgggattacaggcgtgagccaccgcgcccggccttgactttttagtatcacaattttgacctagtgaatactgtgaccagcttttgttggtggggggacggggacgggggcaccaaggaatttatgaccctatgtttataaatacagatatctgaattggaattacaccaacactggcaacatcttattgacaaaatattttaatttcataaagccaatataatcccttgttcaattttctctaaagtacacgaaacagctaattttttccttcttcaactgatcttttcctgcaattattttcactgagataaggcttttctaagtaaattttaaatcaatcggattttacctacttcaaatatttaccaattatagcttctgtcattatgaattctctctactggcaactgctttttgtttattttataaagtccaataacctggatcaaagtctgaagattttaaatctgtcatgaatatttcattcttttgttgatctgaattcaaaaacaaattttactgtattaaatatcagcaaatgtcaattttaattttacttcttctgtcagcttttcaactgtatgaggtttgactatgccacttaacccagtgtctgtcttgttttatgttgactatttctaccaggaattgtcattatgaaatattctacaggactggtctactttaataaaaatccaaccctcccacatacttgtacacttgtgatcacttgggatctcatactaaccttcctcactggtgagtaactcccctctggtgtttcaagtatatggtcacggagacaagggccaggtcaaaatgtccccaagaccaaaaggtctaggccctaacactggagccaaatgttcagtgcatgtgtagacaacgtgtagcacaagtatgtgcctaagtaggaattatgttagctaggagaatctggaaaaagtaagaacttttattctaagaatcaccagctgatattcttttcactaatttccaaagagaaagacatagccaagtcagttggtgagatttcaacaagtacttatcgagaagctgaaactgccctacaaacttcattacttcaaaccattccatttgagataagagctcctctactctctctcactaaaacctcacttgccaagaattcccccaaagccacatggaggcccatggcagcacgaaacccaatgcccaggatactgggcactggtgggcagaggaggatcagtgtgcttgggagactacttacactgagccaagagtaagtttgacagcaacaaatgaagggatgaggacagggaaagctaggtttctcactactggaacacagaaagggaggaaagctagaaagaactatgaggcaaggaacggaaataggagtaccagtgagaacttaaggctattaaacacacacacacacacacacacacgcacacacacagaaggacacaggttacagatgataatgtatatgtgcttgcatgttcatttatattcactgtatcttttctgctgtctgctgagagggcctggaagaaatgtacagtacatcaaagaaataagcacactgaaccccctacatcacggtttctaaatactccatcaaagggaaccagagcctccttgaagaaaaggcttattccaggactggggcaacaaaagtataaactaaacctggaacacaatatgcagaaaacaaggaagtgttcaaagattgaaagggacatgtcacaacatcaggagagccaggctgaaggagctcccactgtctaaatcacaggtctccacgagttgacactgttacaaagaaatgaatgacaatgcaaattaatagacaagagaaagctttttactacagtggaatgccaactaataaatgcagaatgaatgaaaggaatatgaaatcactatttggcaatcagcatagacgtggctgatttgggcaggagtcatccgtggaggccagggctagtggatgaaagtctgatgagagacactggtgtaatcttgaaacatctcaccacaaaatactaatgaattaccaagaggaccacatggtgaattaagtgtgagagaatctggcagacgcaacatgcccaggccagcaaggttaacctcagggcatgcgccctgatgcgaggctctgagaagcacagcatcatttccgtggtatttcttcccaggatgcatggcctgaatctgctcatgaagaaacactcgatggacccaggctgaaaattctttaaatttgtcaaggccatgaaggacagggaaaggccgatttctgtttccattttcagtgcccctttcatggcctaactgccagcaaggccatttattcacttaatcatatctattcattcatttgacaaatatttatactgagctgcaccaaacccttaacattatgccaggtattataaagcaatctaattttatggcacataagctgtcagaaattggggaagcaatatgaacacacaaattctaacataagggatcctgtaaggttgcacagtaaaacaagacttcctgaatgagggataattcggggagcaatttgtcctagatagacaagttttcataagtctaactaaaaatgctactgcaggcactaaatctttttgtattttaaccatttggctgcatttttttgttgttctaaaatatattactcactttcctgccttcgtaaactgaacacaatgtggtcattattttatgcaaattttagttgtataaatctaaatcatgcaacataaaatattaataaagtctcacttcatgaacacacctgaaattatgcaaatgtcccaaattaaaactaagcacctagaattacataattttaaactggcaggctgagtgaattaacctgtgtgtctattactggtccatggcaaaccgatttatctgaaaacagaaataagccaccatacttgtagcttattgagagtcctatgggaaaaatagtctcagaatcataggaattttgaattatgcagacacctcagatacgtatctctgaaaatgccatgacagcaactataatttaacctatttatgagttggcttctactgtggcattaattttctggtctgtgagttaaagacttgctgggaggtctggcggagcagaccctgctagttacctacaaagtacccgtttcctccttcttccttactagcagaacccattttcatccctaggagcctgtgccaccaaaactccccattttccaccctcccttagaacagaaaatggcaatgtgatgcaattcttgccaaggagatgtagagagatgtccctggggagggcatctcccctgaaactaaagggcaaagcttcactaggagaaagttttctgaccctttactctgccccattatttttgttagaaatacagcatgtgagggcagagtcacagcagccacctagagactggacgaatgagggctgaggcctataaaacgagggcagcctggaacagtgcggaaggctggtctctgggaacatcacagcacagctgtgccaaccctgggctgccttcccccacactccttgctacaagagaaaaatgctcctgttactttactttaaatgacaatcatttgggtgggcacggtggctcacacctgtaatcccagcactttgggaggccaaggtgggcggatcacgaggtcaagagatcaagaccatcctggacaacatggtaaaaccccatctctactaaaaagacaagaattagctgggcatggtggtgcccgcctgtagtcccagtcactcctgctgaggcaggagaatcgcttgaacccagcaggcggaggttgcagtgaggcgagatcgtgccatcacactccagcctggcaacagagcaacactccatcacaaaaaaaaaaaaaaaaagacaatcattcaatcaaccaaaggcactgagtgatatttgaggattatttatttgctcctgtcctaaacagtcttaccttattaataccatgtcttttatcttttatattcttatggccattatttatggagtctcagacttttcctttggtcaaagaacccagctaagaaaatcaatacatgacattcaccaggccagagcctggtccagcataaggtccagtgagacagaaatgagaagtaggaaagagaactttaggggaagttttctatgcttgaaagagagccacagaaagagacactgcccctggcctttatccttgtggacgtgaggcctgaactgctgcccatggcatggcacaagcctaccgaggaagcctacgcagaggaggggagatgcaaagtatcccaggaaaatggaaccagacccacaggattcaattagccctgaagaacatcctactgcagaacttctagtatataacttaatatctttattatttagaccagtttgagttagtgttctgttatttgcaaacaggaacatttcaacgacctcagaacgtgaaagactcagcccactgtaagaagagaagaaggctcaatcactctctacctccacatctactactaataacacctccaccaccacctcctcctcttccaactccaccaccaccaccccctccaccacctctaccatcacaacctactccttcaccaccacctccaccacttctaccctcacaaacacccaccaccatcacctccgccacctccaccaccacctctaccaccacaacctactccttcaccaccacctccaccacttccacctctacaaccaccacctccacctccaccttcaccacctccactactacctccaccaccaccacctccatcacctccaccaccagcacctccaccaccaccacctccactttcaccaccactacctccaccttcaccaccacctccaccaccaccacctccatcacctccaccgccatcacctccaccaccaccacctccactttcaccaccactacctccaccacctccaccaccaccacctccaccacaaccatcttcaccactgctacctccaccaccaccacctccacaaccaccacctctacctccacaaccaccacctccacctccaccttcaccaccacttccaccaccaccacctccacaaccaccacctccacctccacaaccaccacctccacctccaccaccaccacctccaccaccaccacctccacaaccaccacctccacttccacaaccaccacctccacctccacaaccaccacctccaccttcaccaccaccacctccacctccaccacctccaccaccaccacctccacctccacaaccaccacctccaccttcaccaccacctccaccaccaccacctccatcacctccaccgccatcacctccaccaccaccacctccactttcaccaccactacctccaccacctccaccaccaccacctccaccacaaccatcttcaccactgctacctccaccaccaccacctccacaaccaccacctccacaaccaccacctccacctccacaaccaccacctccacctccacaaccaccacctccacctccaccttcaccaccaccaccacctccacaaccaccaccaccacctccaccacaaccatcttcaccaccacctccaccaccaccacctccacaaccaccacctccacctccaccttcaccaccacctccaccaccaccacctccaccaccaccacctccaccaccaccatcttcaccaccacctccaccaccaccacctccacaaccaccacctccaccaccaccacaaccaccacctccaccaccaccacaaccactacctccacctccaccaccaccaccacttccatctccacctttaccaccgctacctccaccaccaccacctccttcactaccacctctatgaccaccacctccacttccaccttcaccaccgctacctccaccaccaccacctccttcaccaccacttcctgtgccaccaccaccacctccattaccactactaccaccacctctacctccaccaccataaccaccaccacttctaccaccataagtacaccatcatcaccaccacctcctcttccaccaccaactccacctccaccatgacctccacctccaccactaccactacttctaccaccataaccactcaatcatcaccgtgtgcccagagcagaggagcccacgatgctccctgcagtttcttccaggctctcgtactggtgatgggagaactggtgataagagtgggagtgagaacgggggaaggggccagtcccttccacagaactgggaagcccagaagtggtgtccatgtccctccatggactttctttctaccgtgttctcaccatttcatgcccagctcccttctcaccagccaggcgcccatggtggagaaaaacttaggatgtgtttaaagtcaaaaggcagttttgtgtcaaaacaggtccctgaggcctctcagggtcccaccagtctcatagtaggaagtctcgaggttacattctgtaaccccatatccttatctgtaaaatgaggctgatggtaatagctgtatctatttgacaaagttgttatgaggaggaaatagctaatgtaattaaagtgcctagaacagtgcgtggcatttagtgagtgccacacatagaatcatttgttaaataagttaaattgatcaattacatgcatcaattacatcaattacatgaggggttgagggaggaggagaaatttttcatcttcgatatcttcacagggttacagatatttcctgttagtctgcatggatactctttttttcttttcctttttttttgagatggagtcttgctctgtcacccaggctggagtgcaatggcatgatttcggctcactgcaacctctgcctcctgggttcgagtgattcttctgcctcagcctcccaagtagctgggattataggtgcccgctaccatgcccagctaatttttggatttttagtagagacagggttttaccaggttgaccaggctggtctcgaactcctgacctcagaagatccacccgcctcggcctcccaaagtgctgggattacaggcatgaacctccgtgcctggccagatgcttttttatatcaggagaaagaagtgtcttttcaaatcgaaaaaaaatcactgctattaaaaaaacaaaacaattattcaaggagcagtgacatgtgatttattaacccaaaaatgtactcaaatgtaacattccaaataatatcttctcacatatttccccctctaatgacaaaaactcctctaaagtttttgaaacatgtatcccttttgcctaatgattatcagtgatgactgaatcccctgtcactcaaggttaagggaacatcaccataaactgttaattggatcattgtttctattcactgcacaaaactttttgtagtatttttctgttggcagagagataagcagcaatctagatttacacccacaaagcaggaaataaactgcctaagtttatgttctagaataccttcctcccaaacagaatgaacttcacccaactggctccattcccctattttaggaaggaggtttaataaaagaagctgcaaaatttcaagcaatttgttaaatttttaaattatcacttaaacttctttgactatacacttagaatccaacaccagagtgaaatggaacagctaggaatgtaaacatcattcactaaatctaaagacaaaaggtcacttttctttttcatattgattgttatatgtctatcacccccagggggaaaaaaaagaacctgccatctggtttatgtaccattttactcattacaacattgaagaagggctcaggttttctaggcaaaacacatacacagaacagaattgttgagtccaggctatgcctaagagaattttaccaagcatctctgggacactgcctcaaggaaccagggagactggatggattccaatccctgtcagtaaactaggatgccaatcaattatcctgcagggttacaaaatgaactagaatgcccatcccatttaatccccacagagaaagctgaaacaatcacttctccccaggagtgaaatggcatcattctgatgatgcccgggaccaaagccaacaggctcagctggaacctgaggcctctcagccagaaactgggaccaggaaactacagcaagtggatctcttgctccacttgctatgtttttctaaaagcaataaaagttgtatttttccttagacaaatttggaaaaattaaaagtaaaatataaaaataaaaatagaaatattattctgttagttatacaaatttgatatgtatatatgccaggagattattaactaagtctaagctttcctatttcaaggttctgtatttactttggcagtcatagggagtcatacatttaatcagaatttttaaataaatttgtaaaatagtgtgtaaagttttcagagttgtttgaactgtaagaacatttacaaagtggtatctatggtggctaaggtacttcctaaaggaaataaagatttctattcctatgtaattagaagtcattacagatcctttaccaaataccttcccttcagacttctgtggctaaggttttaaattggttctacatgattatattacaaagtcaacttccttagaaaaacaattctgaatacctttcatcttctaagaaacccttttcgaatccatgtttttttcaaatgtgtagcccccctcttccttctttcataaaagaagacagatttttttttttttttttttgcaacggagtctcgctctgtcgtccagactggagtgcggtggcaccatcttggctcactgcaacctccacctcccgagttcaagccattctcctgcctcaggctcccgagtagctgtgattacaggcacctgccaccacgcccagctaatttttgtctttttaatagagacggggttgtgccatgttggccaggctggtctcaaactcctgacctcaggtgatccacccaccttggcctcccaaagtgctgggattacagacgtgagccaccatgcctggccaaaaagacagaatttttaaagtgtagggaaaaaaatgtttttagccccatgccagaaatgctatatgcccctacatattttgggtattacagtattaattgccatatcttatggtagaaagtgggaggagccaagctgttaagctcttcttatttattttttttattgcttggaaaatcagttattgcttttctaaaaatgaaacatgcgcattgtgaaaatttctaacaatctaaaaacatgcagagtaagatacaggaaatgtaaattgttgctccaccacgcatgacctcaaaaacctgagtaagaaaatgaacacaagttgcaaaaaactcaaatgaattgcagaaattagacttcattaatacattcccattgctgaggaatgaaatgtcagcataccaaagtccatggcttttcaatgcactcttcagaagtagaaaaccaaaatttaaaacaacatcgtccatgaagccaagggaaccattacaccagaacatacagctcctccctggaataagccttctgtgaacctcaacttttcctctcttttaacatcaatgttaaaatgcctcccttcagggatactaagacatttcacttttgagacagagtcaaatagaaaaaccatcaaaaagaaagaaattaattctgcacctgggtagcattattttttccctgcttggagtgtgtactaacttcaaccagatcaattctttcatgaaatgagggagaaaataaactctccataattttaaaacatatttattatgataaaaacatggctctatttgtcatttctatttgtggaaaactgaaggccatctttttctctgtaaagctttttgtctgctacattctagaaacattataacctctccaccaaccagaatgattctgtttatgcaaataaatatattttatgacatgtaaaattaattagttatatgattatgcttcagtaatgacaatgttttgcacaatagaaaaaaagctgataaaatttaaatttccatttttatattccaacaaataatttaaatttgtttcttgattaattcaatgtttcacttttgaaaagcaattcacttcattttgaagtacatttatattttctttagtcaccttaactgttagttctactcagcaagaatttactgtctttttattctttttctgttcttggttaaatgtcttctggtaggtcacattttacctatttatgtcttgtgtcataaaagcattcaagaacattttaaggtaaaatgcttgaataaaattattttagtaaaaatgtaaaaatacatgtaaaataaatgtaaacaaattaaaataaatgtaaaaaaaatagagtattggccgggcacggtggctcacgcctgtaatcccagcaatttaggaggccgaggcgggtggatcacaaggtcagtagtttgagaccagcctggccaagatggtgaaaccctgtctctactaaaaatacaaaaaattacccaggcgtggtggcgggcgcctgtaatcccagctactcaggaggctgaggcaggagaattgcttgaacccgggaagcagaggttgcagtgagccgagatcgtgccactgcactctagcctgggcaacagagcaagactccatctcagaaaaaaaaaaataataataatagagtattcacatttactgagcttttattttcagtagttatagataagagatgaaaaagacagaatttagtttcatactttgatgtcattttttgaaacaatggccgatggtacctttatcattcaaaatttttcaaaactcaaaggacagaaatgaacatatcaggtctaccaaataacctaaacattcattaatttgccattgaaccttatgatacaccaattgaaataaaacctttttacagcaaagaaaattctagtatttgctttatggcattacagtatcttttttattcaagtggggcctgaaagtgccagtgttcctccaaaaacatgcatgaatttaccacatttccatatgagaaataagaacctgtcacttggccttgaaaaaaatatgaccattaatgtaatcacttagaataaaaagaaagtgccaggagttcaagaccagccagggcaacatagtgagaccccatatctacaaaatattaaaaaactagccaggcatagtggcacacgcctatagtcccaactacttgggaggctgatgtgggaggatcacatgagcccaggtgttcaaggctgcagtgagccatgattgcaccactgcactccagtcagggcaacagaaggagaccctggctctttaaaaaaaaaaaaaaaaaaaaaaaaaaaaaagaatagaaagaaagcaccatcattaactgaattgggatccgtactaataatatcagagtaattattgtctggcactaccaggaagctgggtgtttggggttaatcagacacttaagtctctacttatattaacatgtggatttgtgattttataagatattcacattaatactctatcgaacttaaatcaatttttcttgtagaggtcaggaagcatttctctatcttcatatttggatcagaatcatcattatgaaccattttaccaatgttatcatatccatgctagttaagaaaacattctggttggtaaactgttgggtgaaccatttctaaaattaaaaaatgcctgccacaaaataagtctgctgcatttttatgaaaataataaaataaaaactttcatactctttggaaaaatgagaaaagcattgatcagtccacttacagtgagctcacagaaatccatgctatcaaggcttttgcttctgtgtaatctccctttaattcgtcttaaagagggttttccttggctgacactagaagtagcaccattaggattttcagaggatggcgttaccctgcaagaaagaaaaaaattcttaaaaaggcaggtttacaggtgaacacatttctcaagtttgaggtaagcatttactcaaaggcagctttggaaatgtcacactcctttttccagccaaaaagctaagaaccacagcagagctacattctatcagataccctttctaactatttcttagctagttaagacatcttgacaggattcaaatagtacaacattaagatttattagactgtgggtggtggctcacaccttgtaatctcagtactttcagtggccaaggcaggaggatcacttgagcccaggggttcgagcccagcctgggcaatacagggagaccctgcctctacatatacacacacgaataaaaaaattagcctgtcctggtggtgcatgtctgtggtcccagctgcttggaaggctgaggtgggaggattgcttgagcctgggaggtcaaggctacagtgagccaccactgcactccagcctgagagataagagtaagaccctgtctcatttataaggtttttttttaaaaaaagattcattaaatatcaattctacaactattgaagaagccattaatattagactgaagttttctaggtaacttaggggcatctgcttccttctgggcagttatttattcaacactcagtccggtgcctagcacacccagtacaagtgagctatcattgtgtccatcacagatactgttcagcatggttttgttaagcatgaaaataacataaatctaaacatgatagcacacacttaattcagcataattatggaaacatgaaaacacagacaacaagaagtagcaaatagtataagccatctataaagtgcacactggaatacatgttcatacatatacatacagacacagtaaatatcataaaatagactagatatggctacagtttagaataaaagtaatacatccatagagttaaaacatttgaagggtataaaaagatataaaaatggaaagtaaaagctgcccttttctccctcatcccaaactccccttttccaaaatcaaccactattaacagttgtttgtattgtataatctcccagacaaatgctcatgcttatatacagatgtgtttatttccttttcaatttttttaccaaattgtgtgtattgtcctgcaccttacatttttcacttaatatatcttaacgttcttcccataataatccatacagaactatttcactctttttaatggctaaatggtatcccataacatagatgtaatataatttgttcaactattcccctactaatgggcatttagtttgttttcctatgtttgttaccaaaccatacagcaatgaacatccttggcaacatctttgggtacaaatgcattatttagttaggaaagattgctcaaagtagaaaggcagagtcagagatgggagtttcctacatgctgataggtaatacctttccaaaaagctttacaaatttacacttccatcaacagtatatgagaatacccatttgggggagtccttaaatacaagggcaactttatcactttattatttttatcactcaacttctccatgtccttcattatatttttgtctgttgaactgctgattctgtataaaggactattgtaggatttcccaccttgaacatggacttgtcaattaatctatgtcttttagtttttgctttttatatttcaattgttttttattagatgtcttgatgtttatgacacatatcttcttagggatttaatcttttatcatataaaaagactatgccaattaaatattttaccttaaatgccattttgtctgatgataattttcccatctacatttttatattaaccatttcctgatttatcttgtgtttgtattttcaagtgttcgaagtctctctctctttttagttttttttttttttaagttgtacctttaactctggataagtagcatgtagctggatttttttctttctttacccaatctgagggttaatgtcttttaagagaaacttaatccattcaaatttattgtttttactcatatgtttagatctattcctgccatcttgttttgtgtttaatgctttcttcttaagtttctgccttattaatatgattgagtttactttgtcctcaaccaccctaagacctttttccctttccattcagtagtttgaaagttatacatcttattagggaaactctaactctagttagctatatacacacatgtacattaacatctttatatatgtatccatcacacacgtatatgtacacacacacacacataaactcatattttcctatcaacacctagggctcatgagtatgctcacctcctcctaaacaagaagtggcattagcacgtcttcattccccctctttcccagcaactccacatccctacaaaaagccccaccttcccttagaaatagtgttcaggtttcctggcttcttgttcatacttttgatctctttgctcttttgtgattctttaacttacttctccagattgcaaacttgcttttttagttttgtgaattcagccattgtcttttctatgaatcagtaaattctaaatttctaaagtagctagttttttttttttgtttttttttgagtcggagtctcgctgtgcctcccaggctggagtgcagcggcgcgatctcacctcactgcaagctccgtctcctgggttcacgccattctcctgcctcagcctcccgggcagctgggactacaggcgctcatcaccacacctgactaattttctgtatttttagtagagacggggtttcaccatgttagccaggatggtctccatctcctgacctcgtgatctgcccaccatcagccttccaaagtgctgggattacaggtgtgagctaccacgcctggcctgtatctagtatttttttaattaatgcaatattctcatgcatctttccaaaaataacctttttttcttctgaaaatcaccatctaatgtttttctattttctcaggagttagttctgtgttttaatttggtaattctctgggtactggctttcttgaattgtttggtgatttttaatgtctacttacatttgtattggaaaacatccatttccccactgcgactactgtggcctgccttcaggaactctggcagagagatgggatacgctgccaggtctgtgaggcagcttctcttgcaagtcagtagctacctctaggacagccctgcctctctgaccccagtgctccggacaactgtaacgttttctctcaacagatctatccctacctactagttacatttcaaagagtcctcaaaattacgggtccactgatgacattctttattgtttactcagattattattaattttgtcgtagctttaaaaattaattttcttctttcattgaatttctagggcgtcttcctttcaattggcctcccaaagtaaaattttactgatgccactttcatgattcttaggataaaaagaaacattgtacagctttgttctcttctccacagggtaaaagcttccatgaaaacaatgaactttattcaaaagaggacatatgggaaagaaaaatagagttataaaactaaatacaaatcaacttctcatttctctctcactttattttgatagcgctggtaggtgtgatcatattttagaaaattaatgcaaacatttaatataaataaataaatctgtctagtgttcttcgtaagtttttctctcatctgacttagaaaggcatcactattctccctttatgccaaatctagaagcctaaaagagcctgtaataaaaatttatatctaccaaattttataaatggcagatagtcaagaaatttaccagggttaactcaatgtaatactaaatccagtgacaaagtaaaacagaaaaataaaatgatcataaacaaaactagaagaatagatccactgccctccctaccaggatcataataaaaacatgctgtaatatcagcactttgggaggccgagacatgaggatctcttgagcccagaagtttgagaccagcttgggcaacatagagagatcccgtctctacaaaaaatacaaaaaaactcgccaggcgggattgcacatgcctatgggtcccaactacttgggactctgaggtgggaagatcacctaaggccaggacgtcgaggttgcagcgaatggtgatcataccactgcactccagtctgggcaatggagtgagaccatgtctcaaaaaaaaaaaaaaaagtaataatcagtagcgctaaagtggtgtataccaggtgaaaatcagctctggacctaccctgcccacagactccacaggaagatggtaccttgtctaagaatttaaccaggcttctacagagtaacttcaggaactttaaagctttgaccagatctttgggaagctgaggtaaactgttaaaaggcatatggctcaataatgacccccctttgtttggtgtggaataaagaaaagaaaaaacactgatctagataataatgcagaatattaactctggtgtaagtagaagtgctcttgtaggaataggtgaattttagatgttgcttctcttttgtttattactgtctttaaaaatatttgtcttggggaggggcgtgtgtgtttcattgttttctggacactcacaagaacacagctgcgtacctgtaactcaggtgagaagagctatacaaagagtccaccaaggacagttccatttgacatggaatataaattcttttaatcccctggtactactcttccccagccctgatggtgcagatctgagctgagtaactcagacttcagggattattccccgcatatttaggggaatggccctttatgacagggaaataaagttgggaactgatgtagggaaatcaatatttagcttacaatgaggttttacttttcctaattctttttttttttttttttttttttttgagacggagtctcgctctgtcgcccaggccggactgcggactgcagtggcgcaatctcggctcactgcaagctccgcttcccgggttcacgccattctcctgcctcagcctcccgagtagtttcctaattcttaattccattttatcctccctagagggaaggtggggagaaaacttctgcctctctccacctgctttgtaacttcccttgtgagagtgtactttacttgtgggcatggctgatatgcatcaaacgctgaagtccagggcccaccctctcgttccacttcctacccctaccggatgaacacagaccacaggcctggcccctggaggcagtcccccacttgatctgcccatttcccttctcttcacctgacactgctagaacaggtctggtctgcactgcagcctccaccatcatagctcccgaggtaagagaggaagcatcccctcagaggcttgcagaccagtgtggcctgctccagcacagcttcctagacagaccctcatttgggtgatagccagcacctgccccaatattattaacaacccagaaaactgttaacatttagttcttgttccttgaatgtatcttccctggtcaaggacatgcaggagaaagatatacaccaatccaactccacccattatgtcacacctacaaagctctgttgggcgctctgctggctacaggccaaatgtggactgctacatctttgacatgggactcggtccttagcaaagtcatttaaatctgacagagatacaaattttcactagtccaaaatacttgcaccacagtgcagcacaacttcttgacattctgcaaccatccctcccacacccttccctctgctggaatgcttttctactccccatccttgaaagcccaatgttcccaggaagcctcagatattcatgccttttgtttccaactcaggagctttggctacaaatatttctgaccattctaagacaaacaactcccaagctcatctacaccacccatttctaatttccagtggaaaagaactcaataataacacagaatcgggcaaaaataatcaagatggcaaaaacaaagcagtcacacaaggacaaatctatcaacaaagtaacatctaataatccttctacaagatatttgttttaagataccagcaactgacagccacagccaactcaagagaaggctaatgagtgacagcaaagctgtccccttcctccacttgaggggaattccaaacaacagtgtgagccaaggagctgtgagacactgctaagtacagaagggcagctggctttaaaaggatgctaaatccttctgaaggacacttcaggaaaagctagtaaaatgctaatttttgtttataagcattggacttcagaaagcttaataactcatgtaataggttaacagtaaatagtcatctgatgaacttagaaaaaataatgtgcacaactgccaataattaggtcatttaaaaaattgtgggctgggcacagtggctcacgcctgttatcccagcactttgggaggccaaggtgggtggatcacctgaaggtcaggagtttgagaccagcctggccaacatggtgaaaccccgtctctactaaaaatataaaaaattagccaggtgtggtggtgggcacctgtaatcccagctacttaggaggctgaggcagaagaatcacttgcacccgggaggcggaggttgcagtgagctgagatcgcgccattgcactccagcctgggtgacaagagtgaaacttcgtctcaaaaaaagaaaaaattatgaaaggacttgggtattggagcccttcacgtcccaacaggaggacctcagtgatccatgagtgggccgggggaccacccttggagaaacaaccttctatcgggcaattaccagtcattttagtatctgttttcagttattctctccttctagactgtcatctcactgatcaattgtcttttgaaccttgatcaattgtatgagtctgagcaagtcaatgacctaatttgtaaaaccgagaaaatacagcctcatggggtgctataagttaaataatgacaagatacttggaaagcactaatatagagtgcagcaagtaatagctcaatgaatagcaactcttattgtttttggaatctgattattagatgactacttgaatgaatatactgatagtgcatggccttaaataatcactgaatcaaataactggggaaatgtttttagagtataaagaaaatgaaatcacacccccttttctccctaagatcactgtaaatacttttttctttttgagactgagtctcgctctgttgccaggctggggtgcagtggcatgatctcggctcactgcaacctccacctcctgggttcaagcgattcttctgtctcagcctcccgagcagctgggactacaggtacgcgccatcacgcccagctaatttttgtatttttagtagagacagggtttcaccatgttggccaggatggtctcgatctcttgaccttgtaatctgcccgcctcagccttccaaagtgttgggattacaggtgtgagccactgtgcccagcccactgtaaatactcttaaagcacttagtgcaaaactcaagactgctgatagcaataaattatgaaaatatttttcacattttacattaaaaaggagtaactattatttgtgcctcatacctgcagaacagcagcataaatgtcaccttacttagaatgttaccatgtttagaaacaaagtctttgctgatgtaattaaagatctccagatgagatcatcctggatcatccaggtgggccctaaatccaatgacaagtgtccttataagagacagaggaataaggaagcaagactcaaggatgtcagaggagagctgttttagttgcagtggagattctaatatggcctgcagaagaatctgtctgcatatgtatacatcatattataaaatggagcatttattttatgagttcctagtttataatttgaaataaattaaaaattaaaagttttagtcttttaaaaaaagagagacaggagaagacacagagacacagagacacagagaaggtcatgtgaagacagaagcagagaatggattgatgcagccacaaagaatgttcgaaagaggcaaggaaggatcctcccctacagcatttgagggagtgtgaccctgccaacaccttgattttggacttctagcctccataactcagaaaataaatttctgctgttttcagccaccaagtttatgtgatctgttacagcagcccctgaaaacacaaagccccactgcttcttttcatcgctggcaattccagggtgtcccccaaaggaagccagcaggctctgcaaacttatacctacctcaggtagaggtaaccaggctttgttctgtgttcctaagtaatgattcagaaccaaacactgcaaacgcccctgctttctaaatttcttgaagaaggggatgaggaaaagagagttcctacaggctccactgatgtgggtctgactgtctgctttagtttccacctaagttggtctgcaaatataattctccttacgagatttgtagagccaatcagaaagacaggagatattgcacaaagaaaaactgacaggcacaaatgcccaagcgagatggaagtgtgggaataaggcatgcaaccctgccctttacactggcagaagcctttccatatagactgcagtaaagacagagaaacacagatatataaatatcttcatataaatcttcacatatgccttgaccagttttcataatacatcctcacatttatttatttatttatttatttatttatttatttattttgagatggagtcttgctctgtcacccaggctggagtgcaatggtacaatctcggctcactgcaacctccgcctcctaggttcaagcgattctcctgcctcagcctcttgagtagctggaattacaggcacacaccaccatgcctggctaatttttatatatttttagtagagacagggtttcaccatattgaccaggctggtatcgacctcctgacctcaagtggtccacccatcttggtctctcacagtgctgagattacaggtatgagccaccacgtcaggccctcacatttgtaaacaggcacaagctggtgcattccaaagtcttacaagcattgttgatgtctgctattggtttccacccaccactctagagtcaggacctacatcctactatcttctagacatatgatggtgccttatgtctccaatgctccatgtgcggttgctatgaaactagcaaaatgaaacattatctaaaaaataaatccaaagcgtataagagaaaaataaatctggcggcacaatgttctccaacttaagaatatgaagtattctacatctctgtttaaaagagccactcactccagagtcttcatagagcatacccttccctttgccgctgtagaatcagatgaatgtttgcaagttaacaatgagtggaaattaagaaatgattatctaagatcatggaaaagctcaacaaaagcctcttgccttttccaggccgcctcttagtaagatggtttttatccctggccctaactcactgcctacctcaaacatgaattgcttggatataaaagttacctggattttatttccttgtgtcctctcttcagaaattctgtgtttagagaatgtgttttcagaagcagaaccccaatgatggaaaataataaatatagtttcctaactttgtgaccaaatgctgctaatattgatgtctaataattcctcaaatattattcccacatcttgatttttaaactggcccgcgcgcagtggctcacacctgtaatcccagcactttggaaggccaaggcaggtggatcacctaacgtcaggagtttgagacgagcctgaccaacatggtaatgccccatctgtactaaaaatacaaaatattagccgggtgtggtggtaggcgcctgtaatcccagctactcaggaggctgaggcaggagaatcacttgaatcctggagtggaggttgcaatgagccgagatctgccattgcactccagcctgggcaagaagagcaaaactgtttcaaaataaataaataaataaataaataataaataattttaaactgaacattaagaaaacagatttcctaacatattatttcccaatcacaaattattaagaatccatttattcaacaaatatttattgagaagctttctggtacatttgtaccagacatccgttgcagggttttacagtaatggatgaaacaaacaaaagccctccctcatgcaacttacattttagtgaggagaaggggaatatatatgaaaaataagtaaaataaacaatgtgttagttattgataagggctcaggagaaaagcaaaatgggagatatgactgctggtgctgatatttcccatacccccacataccatcaatctgagaagcgatcttcaaatgttaccccttcttccttcactgtagtgacagtcttcatttatttgctaacatctcccacggacatgttttaattgaactgtggctaaccttgtcttctaagtgttgtcacttgctgttcatcacattaaaatatcttttttttttttttgaaataggagtctcactctcgcccaggctggagtgcagtggcatgaccttggctcactgcaacctctgcctcccgggttcaagcgattctcctgcctcagcctcccaagtagctgagattacagccacacaccaccatgcccgggtaattttgtatttttttggtttatttgtttgtttatttagtagagatggggtttcaccatgttggtcaggctggtcttgaactccagacctcaggcgatacgcctgcctcgacctcccatagtgctgggattacaggtgtgagccactatacccggcacattaaagtatcttttgcagaataaatttatttaaaaaaaaaaaaccaaactggtgggggcagaaagacactaacatttactaagcacctattattaagccaagcacagtggtagacacctttgtattcattatcagagttgatctgtgtatatccccatgagggagataacaagattctcactttacagaggaagaaacagacactccaggaacttaaggtcacacagtaagtggcacaactgaattctgaactttgctgtccatatttgtcttaccttcaaaattctccacttttaggattctttttcttaacccatctttttcttggctgatcacgctatatacttttttggtaaggatcactctttcacactgtcttatagagcaggaattactttcctcattacctaaaagcagcctcatctcctttctctacaaccttaggattaaattagactgtgctcaattgaattgaataaaacctttatgaactacactgaccactaattttaaaattaaaatgaccaatgccataactggcatcttttttctgtagtcatcttccctttactaggttatttcttttgcaaaagaatcttaatcctaaatctcaagccagtggcatacctaggtggctcctgggattccgcatggattacggattattattaataaaatgcaatatacaatcctgtagataatcagcaacgtaaaccagtaaggtccagacatttttctttaaggatgttttttcctcattacctcagtaacagtttccaggtcggaggaactggaacgcatgcaggtggaatacagtccctgacaatgcaataataatttcccaacttattccccttgccttgctcgtcctctactatgcactcagcagcagacgaatttttggaaaataactgaaaacgcacaccgtgataccaatgaattcttctgctgtctccgcgagagcctggctggaaattctgagccagaacccgccgtaatggagcagaaaggacagacagaggcgggaggccgacgcccgggtgcgggtgccaggcgtcccggccgctccccgtcgccctacgcgccgcgggcacagcgagggtctcggcgaaaccagtcagcgggcacgcggtacaaggcggcgctcggccctgggctcggccttggctgctgcgccccgcgcggcgcgccccgcgtcccgtcgggcccgacagtcgcggcctcgccccccgcccgaccgccccggccgccgctcgctctcccactccggcccccgccccgctccgcgcctagcccggctggggctccgcgcccgcgcggccgcctcaccacagcttcctcttgagcggcaggaggctgccgcggttggagggggtgacgccgatggccatctgcagcaccgtcaggtatttctggtacttcatcttgtccccgctccgctcgcgggcagggccccgccgcctccgccgccgccgcagacacagcccctccaggcgccgcatagatcagctctgggccatccgccgccaccacagctcccaccgctcccgcgcccgccgcacccgcagctgcggccgtgcgtggcccgggctcccgctcccgccgccgccgtcgccgtgcgtgcccggccgctcccgccgccgccgccgtgcgtggcccgcagctcccgccgccgccgccccttccacccctgcaggccgtggcccggcggcgcgctccggtgggcgggtgcgggtctcgcgggaggccgggctggcttggcccccgctccggagccgctgggcgaggccgggccacctgcgcgccggccgccctgcccaggccctgcgcccgcgtgccgcggtgttttcagcggctggcaggagctccttctcaaccgttagcacccaaagagaatcccaacagcacacttccagcgcggattaaaacaaacaaacaaacaacaacaacaacaaaaacgagacgctgcctgttggtttgtaactatcaattgatgtgttctatcccaaagtggttgacttcacattgacatataatgcatatggcgaatacgtactacacgcgcatgcagtcctcgcttgcacggtaattctggacgctggaaatgactgaaccatgcaaaactaccttaataatcactgggaaaaattaagattgtttcacgactttaaacagtttttctcaaaacattcaaagcagtccgggcacggtggctcacgcctgtaatcccagcactttgggaggcccagacgggaagatggcatgagcccaggagttcgagaccagccctgggcaacacagtgagacccggtctctacaaaataaaaaaaaaaaattagccaggcgtggtggtgtgcacctgtagtcccagcttctcaggagaatgaggggggagaatcacttgagccccggaagccgaggttgcagtgagccaaggtcgcaccacagcactccagcctgggtgacagagcaagtccttgtcttggaaagaacaaacaacaacaaaagaaccattcaaaactcgcttaactgatggttacaaataccctgtatatggaaatgaaaaaaaatcagtttaaaacattcaaacattgagaattaaagtattttttgtgtttgtaaaaataaagcttattaagaataacttgaacagtgcttgtcttcttctagtgtaactcttatataccaccttttctgtactttagcaaaacatcacatttggattacacgcaagtattttatcctttgcacttccaatgccatgcaatgtctcagagagttcctttaatgtaaaatgtttttgtggacctcatttcctccgggacatcctcatccttttagtcacagccattttcctcattcagtgtgctttgagtaagtttcactgactgcatatctagtctctggaaagtcagcactcccacagttgtctatttcttctatagtacttcatttgcattcaatttgaatttcacttcaattccatctttaccatttttttatttctttgctgcactttcatctttgttgaccaattccctttcaattattcatttttatacaatgctgtgtgagtttaacacttggagaaaaggaagcaacacaattgcacactttgctgccagtgcctaaactaacagtgcaatgacccgtcactgacagattttgaaagaactgctgtgattggtcactggttgttatggacatctattgtttacatagggttttgtggactaaagagctagaagcaaagattgtactatgtttgttcacagctaaaatagcatgataactaaaatttgttttttttgtttttgctttgttttgtttttgagacaggatctcatgctgttgcccaggctgcagtgcagtggcacaatcatggctcactagagcctctacctcccaggctcaagcgatcttcccacctgggcctcccaagtagctggaactacaggcatacaccactaagcctggctaatttttgtatttttattttttgaagagacgggatctcactatgttgcccaggctagtctcaaactcctgggctcaagcgatcctcccacctcagcctctcaaagtgctgcaattataggcatgagccaccatgccccatccagtaactaaaatttcaaccatattgttgagatactggtgttatttaactaaatagctgacatcagtcatatctgaacctgcaaagcaaaggatgcctatttggatatatgcatactatatatatgtgtgtatatatagtatatatgaagagtaccaataataagcacctatgcatccaccaggcagaagtgttaaccccctccctccacagtttatccctcctgcacctctatttaaatacttcatcttcaaattaattagcacataagattaaaacaacacaatcttcctggggtttgggttcccaacatgatttcacagtcacttaggtaggaaagcaggtctaaatatttcactttcatttacccagaaattttagctctcacataaaatgaggaattggcaggtttttgacacttcggttgtatactcccctggggagaggacatccttggagcagaacttttaagaaacatcaaggcctgtttttatatactcaccatgtcaaatatatgtttggccttttgcattactttgtcataataattgtaagatatttgatgaaaatactacactgtgctcaaagatttaggcacctggaagctgagggacctattcaggataataagcaataaaaataaatctgggagaagcacttctagagtggtagaaaatctgcttctccataaaagggagtacactggcaaaaatagttaaaaccaactccagaaattaaccaaacacaacaatccaaggagtatttattaaagaaaaattactgaatcttggtgagtacagtgagctttagggcattttgatctgcccaattctcaactacttctctccagctctacagtagcctagtaagccaacagcctcacaactacagtagctttgaaaaccatccagcagccactggatggggcagaataggtttagatcttctcaaaagccccatactaagtaaactgtcattatttgacctgtctggaagcaccttgaaaagttccattctcagggtttgtctttatttgacctggttcagaacttgctctgtgcaaacagccctatccctggtgcatttgttgaaaacaatcagttgcaactgtttaacatcacagatacctgcggtggtgaaactgtttggtactaacaagaagctaaccaaaaaagttaaaaaaaaatgggcaataagagtccatatagttccttgaaaagctctgacatatacctaggaatccagaatttcatgcaggacatgcatgtacatgcaggactgtgaacacacccaaaaaacacctaagaagactctaatctctcacctctgtctgaccttgagtttcagtacaatgcagaaaataaaggctaaggaagaatcgtaaactacctaccacaatgtgcaaggcatgccccagcacacacagcctctcagcaaaagctaggggatttattggctcaaagcatttaagaaaatatccattcaatcattagctaagcactaaactatccaagcagagactctaatggctgcacacaacaaacaatacagactttatagattagtccagcaaagtcactaaaccagcaacaaacctcagtggagaggaggggatatgatttctagagttgtcacattacattgttcaaaacatccagatctcaacaaaaaagttcacaacatccaaagaaacaaaattatggcctatatgcaggaaaaagcagttaatagaaaccattcctgaggaatcccaggcattggacttactgaacaaagactttaaatcagccattatgaatatgttcacagaactaaaggaaaccatgtctaatgaactaaaggaaaatgtgagaatgatgtcttactaaatagataatatcaataaacagaagttttaaaaaatagaaactctggagttgaaaagtacaaagagtgagatgaaaaaattctctagaggagctcaataacaacatatatgaactggtagaagcaaaaggcagtgaacttggagatagctcaattgaaattatccaggctgagaaacagaaagaaaaaagaatgaagaaaatgaacaaattctcagagacttatgggaaaccatgagtttatgtgtatattaacatgcacataaagtcccagaaggaaaggatagagagaaaggaatacaaagaatatttgaagaaatagcctgcccagactttatgaaaaacagtaatctgccatccaaggagctcaaaaaacttgaagtagtgacctagacacataatagtcaaactgttgaaagccaaagatgatgagaaaattttgaaagcagcaaaagaaaaacaactcatcacacacaaaggatcctcaataagcttaatagctgacttctcatcataaatcatgaaggtcagaaggtggtgggaagacatcatatttaaagggtggaaggaaaaatatccttcaaaaatgaaagagaaattatggcattccaggtaaacagaaagtgaatgaaatcatcactagcagacatgcactattaccaaagggaaccttgcaggctgaaatgaaagaatattagaaatttaaatccacataaagaaaataagagcagtgattctgataactacacaattgaatataaaaaattattttaatttttaaaattaaaaaattttaaattaaaaaatctgaacactctgatttaaaacacaactgcataaaacaatggctatgagctgtgtcgataggcttttaatgtataaacatacaatttgtttgacaatcatattacaaagataagagggacagagtggatgtatactggagcatagttttggcatgctattgaaattaaggcaagtcggctgggtgcggtggctcacgcttgtaatcccaggactttgggaggccaaggcaggtgggtcatgaggtcaggagatcaagaccatcctggctaacacaatgaaactgcgtctctactaaaaatacaaaaaattagccaggcctggtggtgggtgcctgtagtcccagctacttgggaggctgaggcaggagaatggtgtgaacccgggaggtggagcttgcagtgagctgagatctcaccactgcactccagcctgggcgacagagcaagactccatctcaaaaaaaaaaaaaaaaaaaagagagagattaaggcaaggcacggtagctcatgcctataatcccagcactttgggaggcctaggtgggagaattgcttgagcccaggaattcgagaccagcctgggcaacacagtgggacttcatctctagaaaaataaataaataaataaataaataaataaataaaaaattagccaggcatggtggcacgtgcctgtagtcccagctacttgggaggctgaggtaggaggatctcttgagcctgggagatggaggctgcagtgaaccatgattgtgccattgtactccaggctgggcaacagcaggagaccctgtcttgaaaaaaggaaaaaaaaaagaaattaagttagtattaatactacttaggttattttaagttaagaagctaattgtaatccccgggatgactattaagaaaatgattttttcaaaatgttatacaagaaataacaaggaaattaaaatgatacagtagagaatatatagcacaaaagaaaacagtaacagaagaatagaacaaaacaagatataagacatatagaaagcaaatagcaaaatggcagacataaattctaccttaccactaattacattaaaggtaaatgtactaagcattcccatcaaaagacagagattggtaaaatggatcttaaataaatgtataacctaatctttcactttgagcaactagaaagaggagcagaataaactcaaagcaaggaaaaggaaggaaataaggattaagagtagaaataaatgaaatgatgaataaaaaaacagagaaaatcagcaaaaccaaaagttggttcttaggaagtattaaatatcaataaagatgacaaaccttcagctagactgaccaagtgagagagagaactcaaattactaaatttggactgaaagaggggacattactaccaaccttgcagaaacaaaagtgattataaggagtatactaaattatgttgtcccagctactcggcaggctgaggtgggaagatcacttaagcccaggaggtggaggttgcagtgagttaagattgcaccactatactttagcctgggtgatagagcaagactctgtcaaaaaaaaaaagaaagagagagagaaagaaagaaagcaagaaagaaagaaaagaaaaaaggaagaaagaaaaaaaagagagaaaggaaggaaggagggaaagaaagaaaagaaagaagggagggagggagggaaggagggaaggacctacctacgtgaattagaaaactttctagaaagaccaacctactgaaattgactcaagaagaaacagaaaatcaaatagaagtataacaagcaaagagattaaattggtaagaaggaaaacttcccaccaagaaaaaatggctttatcagttttgttcattcctttatctcctgcacccagaacagtgcctggtgtatcataagcaaccaataaatatttgttgaacttgagacaggatgttaatataaagtgaaagacttcatgacttgtcataaggcatatcatttttctaaagaacagagttttgcatgcaatgtagataaatattacagctggaaaattgacatcattttatgtagtcaaagaaataaaaattcgctattagttctcagatgatagttaatgcttcaaaggaaaatgtgggagctgctactattggcactatgcaaggtccaaggtagtgtttttccaacctgcctcccagtgaatacaacctcaagggttatagcacctgagcctgttgctccaccttcctcaaaaacaagatcctttcacctattttgactaccacgcacagttagaagtatattttattttattttattttagatggagtcttgctctgtcaaccaggcttgagtgcagtggcgtgatcttggctcactgcaacctctgtttccttggctcaagcaattctcctgcctcagcctcccaagtagctgggattacaggggcccaccaccatgcccggctaatttttgtattattagtagaaacagggtttcaccatgttggccaggctggtctcgaactcctgacctcaagtgatgcacctgcctcggcctcccaaagtgctgggattacaggtgcgagccaccgtgtctggccagaagtacatgttaaatagtggcacagtacacacagacacatacaggcgtacacacagacacatacagacacacacacacacacacacatacacacacaactgaagcaaaagcttctgaaaacaatattttaccttactacctgggttgaacttttctgttctcttctacagcaagccactctacatccttagcattttgttggaacattctcatcagctcctatctttgcttgaagctggactgtcccccaattcagctgccctcggcagccctcagtgccccaatgctgccctcggcagccctcgacaggaggtgttttatctcttgcaccccacatgtctaaaggccagaggttggggtaagtttcttccttgttggtcctgccccttctaaaccattccttgctctttctcatgcccaaaccaaaccaaacaaccaaaaaaaactaaaaactggctgccctgaagtttatgcccttaaaggatattacctacccctttcccctcttctttattgtcgtttactgccttcctctccacttttattcctggcataattttttttttttttttttgatacggagtctcggtctgtcgcccaggccggactgcagtggcccgatctcggttcactgcaagctccgcctcccgagttcacgccattctcttgcctcagcctcccgagtagctgggattacaggcgcccaccaccacgcccggctaattttttgtatttttggtagagacggggtttcaccgtgttagccaggatggtctccatctcctgacatcgtgatccacctgcctcggcctcccaaagtgctgggattacaggcgtgagccaccgcacccggcccctggcataagtttgaatgatttcaacatccatgtgggtggaccatccaatgctcttgcctctcagttccttggtcccatctcttctagagatcttttccctattctacttcagccttgcacttgtgtggtcataccttaagcctgggctcacaaactcaaatgccagtagggtaaggcccttactaccaatgagtgaagaaggccagatgttagtcagcagaaaatagtggaagctgtgacctccctgcctggtgctacagttctcttttagaaaggagtgaccgccactcagctgcagccagctgtcatgtggaaatgctagaccaggatttccacatcttccaattcatggaaacacaggttgtcatgtgctatctcccaaattttacatattggcaataatatggactttcagtctaaatattgtgacattaaaaaacatttcccctcttaaaaatcagctcaaaagaagaaaaaaaaaagggaaaattaaattatatcttccttgaaacgtggagatattccagaagttagaaaacagtgaagatttggccggacgcagtggctcacgcctgtaatcccagcactttgggaggccgaggtgggcggatcacgaggtcaggagatcgagaccatcctggctaacacggtgaaaccccgtctctactaaaatacaaaaacaaaattagctggacgcggtggcgggcgcctgtagtcccagctactcgggaggctgaggagagagaatggcgtgaactcgggaggcggagcttgcagtgagccgagatcgcgccactgccctccagtctgggcgacagagcgagactctgtctcaaataaaaaaaagaaaagaaaacagtgaagatatggtaagtgacttagcagaagggaggggaccaacctcagtgactatccagggcaatgccatgaagaaacaagctcattgcattgcagaagcacggaaatattcaggaatgaattggaggctccaggtaccacaaaagatagatgggaatggaaggaggtggcaggcactgaaaataggagattgatctaaaatgtggaataggaaacacttattaccccggtatcctctctcatttcagcggaaatggaagtatattctcaggagaagaactagagagtggcattaggtacaatagactgaaaagaaaaggttacaggaaagttgtatatggagtgatgagatgctaagctcctttctgccacccagatgcagaatgctagcaacctcagacaagagatttacgtatcttcccatgtagaccgttacaattttttgttaaatccatagatttcattgttgtgactgtttaaacattgtttagtaccgaacctagtattgtcccgtgattatattttcctgccttatacaatttcttattttacctggagttaataattgccttgttttcaacttgttgttttcctaaaactcatgactaagtgttcccacatccgcaagagtaatgtcaaatgcctgcaatacagttttccacacactcaaaccagacagagagtctacccatttcagtttttcttggactcagccctctgaagccctccatcctgctgctcctatctgtacagatgtgctctccgggtttctgcccagttcagagagagagagagagagagagagagaggaaagagagagagagagagagaggaaagagagagagagaataagaaagagctgtttattttaaggaattggcacatgtgattatcctctctgtacagatgtgctctccggggcttgtgcccagttcagagagagagagaaagagagagagagaggaaagggggaggggggagagagagagaagaaagagagagagagaggaaagagagagagagagaataagaaagctgtttattttaagtaattggtgcatgtgatcatggaggcttgcgaaatacaaaacatgcagggtagctggcaggctggagacccagagaaaagttgtagtttgagtccaaaggcagtcggttggtgtcagaaattttcttgctcagaagacgttagtagttttattctattaaggtcttcaactgattggataaggcccacccacattatggatggtagtctgctttactcaaaatccaccaattaaatgttaatcacatctaaaaattgtcttcacagaaacatccagaataatgtttgatccaccaggtaggtttgagaaacaaggaatgaagagtaaagaaagtggtaaatatgtggatgaatctaagcaaatactgataaaaaaataataataacaatgtcttaatgggttaaaaagaataattaaaatacatagaataatagttcataagttgggaattaagtaaaaagaattaaagttttttttttttttttgtggtggggacaggttttcactcttgttgcccaggctggagtgcaatggcgtgatctcggctcattgcaacctcagcctcctgggtcaagtgattctcctgcctcagcctcccaagtagctgggattataggtacccaccacccctcccagctaatttttttgtatttttagtagagatagggtttcaccatgttgagcaggctggtcttgaaattctgacctcagctgatccacccgcctcggcatcccaaagagctgggattacaggtgtgagccaccacacccggtctagtgttctttcttttattatgaggagaaagttaaaggatctgttaactttagacttgattatattaagtgagcatattataatttctaaggcaactactaaaagaaatgaacaatgcatagcttttgaactatttaaaggggaaaacattgaaatgattaaaatactcagtatatcaaaaataaagtaaaaaaggagaaaagaaaaaacatggaatgggtgtgtcaaatagaaagcggtggctcacacctgtaatcccagcactttgggaggctgagatgggtggatcatgaggtcaggagatcaagaccatcctggctaacatggtgaaaccccatctctactaaaaatacaaaaaattagccaggtgtggtggtgtgtgcctgtaatcccagctactcgggaggctgaggcaggagaattgtttgatcccaggaggcagaggctgcagtgagccaagattgcgccactgcactccagcctgggcgacagagcaagactctgtatcaaaaaaaaaaaaaaaaaaaaaagcacaaaatatgtttgcagatttaaactcaaatatatataaaatgtgagttgtgcctttaggaatggtgcaatgtcatggccttaacaatgtagtgttaattacatttcatgtaaataaactaaacgctccagttaaaagattttcagacttgataaagacaaattctatctccatgttatgtacaagaaacatgttttagaattataaagatatagaaaagttaaaaggtaaaaggttatataagatataccaaaaaagcctaagccaaaggaaactagtatagctatattaagaaagatatggttttaaagaaaataaaattacaataaaaaatcagtgaagacacaaaaggtttgaataagataatatgattgacatagtgagatctccacctaactactgcagaatatatatatatcaaacatacagaaaaattattaaatacaaatgaacaaataaaagcaagtctcaatacatttcaaaggtttaaaatcatacaatgtgtgttcttagattataagacaagccagaaatcagcaaaaattcgaatgagaaaaattaatatgttagggattaaaagacaatcatgcttcaaaacaaaattgtaaaaatgttagaacatattttgaacagaattatagcaaaatattgcatataaaatttatgacataatttcaaaataagtatattcagagaatctaaaaattaattaagtaaacattcatctcaagaagttagatatgcatgagcaagaaggaaataatgaagataaaaggagaagtctttgaaatagaaagcaaatatataatagattcgacaaagccaaatgctgcttcattgattttaacaaaattaaaatatctgtcaagaagtattaaaaaaaaattagaaggcacaaatagtcaatatgtagaaacagaaaagagacacacttaggtatatttcagatatttaaaagataatacaaggttaatatgaactggaaaaatttagacaaaatggataatcttctaataaatatataacccaccaaagtttattcaggaagaaataggaaatctataataagagataggaaattttacaattatggtgcccatacaccccattttgcccaggacagtcccagtttatatctattatggattaatgtccattaattattttcataacccctttaattctcaaaagcgctccagtttggaggataagccatatggtcatcctgcctgtttataataattagagtaactaaatccgtagtcagaaatgttccgcaaatgttcctcctaaaaccattccaggcctcaattcaccaaccagttctaccaaacattcatggaagaaataatttcaatcttagccaaactctttcacaaaatagaaaaagaggaaatttttcctgactcttaagactagtgtaaccttattactaaaatgtggcaaagacagtacatgaaaagaagattacaggcaatgtcaagcacgaacacagacacaaaactcgtaatccaaatatttgcaaactgaatttagcagtatctaaagggataataaattatgaccaagttggcaatatcccaggaattcaaaattggttttatgttagaaaataaactaaaataggccgggcctggtggctaacacctgtaattccaatgctttgggaggccgagatgggaggaccacttgaagagtttgagaccaacttgggcaacataacaagattccctctttacaaaaataagaataataacaaaagctggatgcagtgtgtgtgcctatactcctagctactcaggagactgaggtgagaggactactagagcccaggagttcgaggctgcagtgagctattattgtgccactgcactccagcttgggcaacagagtgagaaactgtctctaaaaaaaaaaatcaactaaaataattcaccatgttaccacattaccacattagagaagaaaaatcataacatcttctcaatagatatggaaaaaagcatttcataaaattcagcatacattcatgatttaaaacctcttatcagagtgagaatacaaaggaacttccttgatagttatcttcaaaaatcatacagcacatctcactcttaatggtgatattaggtggagatcagggcaacacaagcttcctactatcattgcctctatttgatattgtgatggtggtcccagccaataaagtaagaaaaagattgtgtaagaactagaaaggaaggaacaaaactgccattattagtgacgaatatgcttatgtaatagaaaattttaattaaaactacatatattattattagaattaatgagagatgaacaacttttctggatatgaaaaatcaaaattgcctttctttacatcagcatcaaagcactggaaaatggaaaaaaaatatacatttacaatagtgtcaaaacatataatgtacctaggaagaaaatctaacaaaaatgttatggagaaaacaataaacctttattgagagatatcaaagaaactataatggacaaatatatagtagtccccccttgcccatagtggatacgttccaagacccccaatggatgcctgaaactgcagatagtactgaaccctatatacactgttttctcctatacacacaaacctaggattaatttgtaatttaggcacagcagagactaaaacaactaaaaataaaataaaacaattatgacaatgtgccagcattattactctttcactttagggccattattaaataagataaggattccttcaacacaagcactgcaatactgcgacagtcggtattgaaaactgagatggctgctaagtgactgatggatggggggcttgtatagccgtgggtgctctgggcaaagggatgactcatattctgggctatgcagagcaggacagtatgagatttcatcccccccagtcagaacggtgcacggtttaaaacttatgaattgtttatttctggtgaattttccatttaatattttgggactgtgactgaccaaaagtaacagaaactttggaagcaaaatagtggataaggggagactactgtaacaagtttctggattagaagattcaatattgtaagcatatcagaattttccaaatcaacccatagattcagtgcaaacacaccaaacacataatcgtttaagttattgagcttggcaaactgattctgacgttaaaatggactgatagctgataatttttttttttttttttgagacagagtctcaccctgtggcccaggctggagtgcagtggtgcgatcttggctcattgcaacctccgcctcctgggttcaagcaattctcctgcctcagcctcccgagtagctgggactacaggcatgcgccaccatgcctgctaatttttgtatttttagtggagacggggtttcaccatgttggccaggatggtctcaaactcctgacctcaagtgatccgcccgcctcggcctcccaaagttctcaggcgagagccaccatgcccgaccagctgagactttttttttttttttttttaagacacagtcttgctctgtcatccaggctggagtgcagtggcgcgatcttggctcactgcatgctctgcctcccgggttcatgccattctcctgcctcagcctcccaagtagctgggactacaggcgcccgccactacgcccggctaattttttgtgtttttagtagggacggggtttcaccgtgttagccaggatggtctcgatctcctgacctcgggatccgcccgtcttggcctcccaaagtgttgggattacaggcgtgagccactgcgcccggagctgagacattcttaaggaagaaaagcaaggtggaaataaatatttgtcctgtacgatgttgagacttaatacatcactagaatgattaagaaggtataaggttggctcagggatagacaaatagacccgtagtacagagagagagccccaaaatacacctagacacatatggatacttgatatacaacagagttggcattgccaataagtcatgaaacgatggctttttcatgaaaggtgctgagacaattgggatttcttataaaagaataaaacccaaaatggtcctataccttacattacactaaaaaatcatttataggtaaattatatgtgaaaagcaaacctgtaatgcttttagaggataatatagcagatatctttaagacttgggaatatggaactatttcttaaatattacattaaagcatctagccataaagtagaagattaataaataaggcaatattaaaactaagagcttctatcatcaaaagacacaagactgggagaatatattcacaatatatataattggtgaaagattaatctccgaatatatatatttatatagtttttaaaatgcctacttatcattgagaataaggcagacaactcagtagaaacatgcacacaggggccgggtgcggtggctcacgcccccagcactttgggaagctgaggagagcggatcacgagttcaggagttcaagaccagcccggctaacacggtgaaaccccgtctgtactaaaaatacaaaaaaattagccgggcgtggtgtcacgcccctgtagtcccagctactccggaggctgaggcaggagaatcgcttggaccaggaggcgaaggttgcagtaagccgagatgcgccactgcatttcagcctggtgacagagcgagactctgtctcaaaaaaaaaaaaaaaaaaaaagaacgaaagaaagaaaaaaagaaacatgcacataggagttgaatagacaactcaacaaagaggcattccagatgtctgataaacatatgaaaggtgtcatcttcatttgcattcacggaaatgcaccttgaaacaacagcgagataccctacaatcccaacaggctggctaaaattacgaaatctaaaataagtttgggaactcaaaagcattgctagtgtgagcacaaattggcaaaacaactttggaaaacagcatgacattatggcatagttgtcaacgtattgcttctcagctcaaattcacttttcaatacaagctttgagatgagggaatttctttaagcatttctcctctaaagtgagcacgatgttgagctttctcagtagagggcgctaggcaggtgttgcgggagggaggggcgcttctgcagtttctggcggaggctcagtggtcaaccgtgcgggtgggaaggggtcgggtggattctgcccttccatatgcccagagttccaagtccctcagcgacttcacagcccccttgtctgctcaacacggtcactatgtgtttcaggcgccctcaggcctgttgcacagtcacacgcaggccaccagctgcggctcccctgcccagcctgcactttggagggttgtttcctgttttttttttccaccactgcaaaccatcaaatttctctgccatccagtgggttcaactacaccttctccaacgaagtcagaaccacagttttggagagggagccccttgcaagtttattcttccttgggtaactctctcttggccccaaggcaccatgaaagttttcttattttctatagctactcctttatcccaacttaataattctttatattaaactctccctttgcggtaggagtttatattaaactaaaccctttgtgtttaaaataattgcgtggtttctatcttctgattggatccaccctgctaagtattgagaatgtgccatacaattccacagcaattccacttctaattatcttttctagaggagatttttgcacacgtgcattaattcacaggaaccaaaacgtttatagcagcaatttgcataaaagccaaattctgaaaataactcaaatgttcatgaagagagaacagataattaaattgttacagtcctacaaggaaatgaaaatcagtgaactacagctagacagaacaaaatggatgaatgtcacagacaatgttcagtgtgaaagaagcaggttacaggttggtgtttactatataatcccattgatcccatttaaagttcaactttatttaaaactaaactacattgtttggagatatatatatattaaaaccataaagaaaagcaaggaaatgaatattttaaaagttagaatagtggctacctttataaggttgcttttggggtgccctctttgtcatgcggatgtggttacataggtatttgaattacaattcctctttgacttatgcatatatgttctgtgcattctattaaagtctttgcaattatgtaaactaataaccacaacacaaagaaagacacagttcctgcctttatgaaacttacggggagaaagaacaaaacagaaaacgtggaatcacttaagatggagatagcatgattacattttctttctttctttctctctctttctctctctctctccttccttccttccttcttttcttttttgagacaaggtcttgctctgtcacccagggtgggatacagtggcacgatcatggttcactgcatctttgacctcctgggctcaagtgatgctcccacctcagcctcccgagtagctgggacaacaggggtgtaccaccacacctggctaatttttgtattttttgtagagatggggttttgtcatgttgcccaggctggtctcaaactcctgggctcaagggatccacctgcctcagcctcctaaagtgctgagattacaggcatgagccactgtgcctggcctgcgattcattttttaaacaagtatctttggactgcaatccggctagattagaccttggaacaatgaaatatgacaaacattttaaaaatgcattgttcagctggcaagaaagtatggtgaattccaagggtggaaaacaaagagataatcaacaagcagagatatggggagctgatgctgtagttgccttaggtgcagtagtgatgtactggtctcagtagccaggcagcttggattttaatggtcacctgctgtccaggacaggctttgggcctaagggagatgggaaggttgaagtgagaccctggataaagctataccacagggacatgatagactagaaaaaaaattacggacacagggagacaaaataaagcttttgtgttttggtttgcactccagttagaataaaatcaggggtgtaatcccagcactttgggaggctgaggtgggcagatcacctgaggtcaggagttcgagaccagcctggcaaacacgacaaaaactcatctctaataaaagtacaaaaaaattagccaggcatggtggtgtgtgcctgtaatcccagctgtccaggatgctgaggcaagagaatcacttgaaccctggaggtggaggttgcggtaagccaacattgcaccattgcattccagcctaggtgacagagtgggactccatctcaaaaaaaaaaaaaagaaagaaagaaagaaagaaaaaagaaaagaataaaatgcagggaaaaatgtgcccagagaagattgataatcttgataatccagggttggacctcatgttggtctgatattctaaattacattacccatgtgagccagtaatctctaggtagaaacattaacataagaattaatcactctaggatgatactactgctgggcacctggcagaagcaacataaaaccgctttagagaaatacacctgtacccaggtcacatggaacgtccaccaaatgggagctcatgaacctaaattacaataacatgatgaaataattcatcctgatgaaaagtcaacagacgcaatagtcagcaagattagactctcagaactttagaaaatataataaataaatattagtaaaatatcaagattataaaaccaggagtcacataacacaagaacatcttagtatcaagaaaaaattaatttgaaaaaactagactgaacttccagaaataaaatatgtggtcaatgaaattaaatatatcttcttgcataatagttcctaaggcattggcctcaaagtagtctttacaggaaattggagctgcctagagtcataatgtcaggtgagtgataatttacaagcaattatagatatagtgatatatttagaggtgagagcagccttatagatatactagtgacactccctttggtgaaagatataaaaatcttagccccaggatgtaaaccaagtcacagataacagtaaactcccatctagagcacacatgttctgacacctgttaagtgccttttcagatatgtcacattcccctatccatagacacaggcacctgctgagagaaagatcagggaagtttgatgacacttgttgcagtgaaaagctggtaaaaggagaaaggaaagaggctatctcagacctgaaaaggctgggagactatttttgtatataataacaggaaatagtcttcacattatataaacaggaatttaatggaggagagccacccagggactctggggaatgctggaatacatacttgcttacgtcctgcgagggtggatttgagtgaggagcagggcagtgaattctggcacttgtcagtgccagggctaaattattctgctcctgtttggtggaggtaacagctcttacatcactttaattgtttccttccattgacgtgaaatgaggaatttcttccatggagtgcttggttcaagcactgccaagagttggcaaagctcctagtggcatctttcacttttggtctctggtggctcttaaatacagatgaattgtgtaggaaacaaacaggaggaattatcaatcatatgtgtctcctctcaagaaaatgtgccattttcctcttatatatactgcgatggcatttgttttttcaagtttgctcagttcacaatctgcacacttcaccttcttcaagaagtctcctaggctgaaagctattgtcagctgttctgtgattctatcttgtgttaccattgcaggtgtacatgtcttacctccttcagtagacagtgacttcggaagacagatcctggtctgatccatttttgagttctctataatggctttcccagttcctcacacacatttggtgcttaataaatgtttgtcttatgagtgaaccgatctttgatttgttgtgtagtaaacatacaaaattctaggctgtatcagctagaaattatgttggtactagtgactgagaacctagcatagtggcttaaataaattaaagccttctttttctgtgatgtaaaaaaaaaattattagtcttgtcagtccaggatgggtaaggcagcttcaccacatcatgagggacccaagcacttccttccattctgcgttcttcagcatgttgcttgcatcttcgaggtcacaaaatatctgccagagctccagccagtaggtctgcattttaggagaatagaaagggaaagacaaggggcaagcaggctcttccctcattggcatgaaaaaaccccagtaaagagagttgcaggaaacaccaatcaaagacttatatttaaatttcattgaccagccccttaactgcaagggaggatggggagtaaagctttttagcttggcacactttccccctaagcaaaatctgagttatgtttctaaggcacaaagagagagaggatattgggtaagcagcctgcagtctttgccatgaaggatcttaatcattcatcagtaagtatgatcttttttttttttaaatgtcaattgtttctttaagatttttagtttctcttcaaagtctataggtaaatcactgaaatttatccagatcccagccttcacatccagggattttggtgtaccaccatctactcaatgctccccgtcctcctaccccatcaaatgagcttcgtttgtttttcctttatctctaagtggtatgacaccatctgctgttttctgcttttgacccagagccatgtctggcatcatcagactaatcaagaggtgggaagggacaaggtcaggcatgggttagtgacacaaaccacttggtaattaaaaaccccttggtgataacattttctccttgcacaacaaaatatccattgcaggattttgataaaattctgctctattaatcatcagcaattggaagctcagaatgtgaggctaattgtcagattgatgttgcggctgagaggaagtattaaaatttcgcaaagaccataagagaggcagttatagaaatagtgtgctaattcttagcttacatttccatatatgttaaatttctcttagaaattatttggattactgatgtacaagtgattactaaagataataattaatcaatttagtcctccattccattaatcaataattgttgagtatatactatttgccaggcattgtgctagctgcgagagctataaatgagagttttttaaatgtagacgtttctgagttaaagatacactgaaaggctaaaatgaacagcaggaaaatgagatgataatctgaaatcagcttccatagaccaataatcccagaaaggctgcgagaaaattaatagcagaaactaagcttgggtattttgcaattctcttttagccacacaaaattaaattagaaattctgagaagactcaagcagggactgttaatatggggttttgacatgtattaactagacaatctttatgaataaagaaaagagaacaagtcgcttccatggcataatattaaaataaggcctcctggatagccactattctgaataagataagaaagacgatgccattacagctaagcagctcaaaattccattagaatattttaagcgttagtataggaatttacacaagagttagagaaaatgaaatttaaaaccaagacctgaaaggcactcatgaatttaagggcaggtcattttgcaggggttgggtggggcaggagaatcactggattgtgaaattgaaattgaaattgaaattggttaatttcaacggactacttgatacaattgatagccatggatttggcaactgtggatgccagggcagacagagtttgctcctaagaagatgcccaactcagagacgctgggtcctgtgtcccatggtctccagtgcctttcatttggagatcatatcactgtcctgtgcttttgaccttgttagttggtctgacatacttgttttcttccctttagctgaatgaataatttataatctctggaaagtataaaaacccaatgtactcttatgtaatttgtgtttaaatgtaaccattatgatgtcctgtgcatactatgttaatgttttaaatgatttttgaaaggcttaaaaagatttctctctacaaaatttataaggctgatgtagtagattgttaagaggaaggtttcttacatttgtaactctccctttgtatatttcgaatgtttgagagggggagttatattaaaataaaactttcaaatagccaagggaatttgattggttaaatatgcaaatgatgtttaacatgaaacattactcctggccaggtgcggtggctcacacctgtaatcccagcactttgggaggctgaggcgggtggatcacaaggtcaggagattgagaccatcctgactaacacggtgaaaccccgtctctactaaaaatgcaaaaaattagccaggcgtggtgacgggcacctgtagtcccagctactcgggaggctgaggcaggagaatggcgtgaacccaggaggcggaggttgcagtgagccgagatcgcgccactgcactccagcctgggcgacagaatgagactccgtctcaaaaaaacaaaaaaaagaaacatcactcctgtaatcccagcactttgggaggccaaggttggcggatcacctgaggtcaagagttcgagaccggcctggccaacatagtgaaaccccatctctactaaaaatacaaaaattagctgggcttggtggcgcaagactgtaatcccaggcactcgggaggctgtggcagaagaatcgcttgaacctgggaggcagagtttgcagttagctgagatagcgccattgtactgcagcctgggcaacaagaatgaaactccacctcaaaaaaaaaacacaaaaagttaatgattatactttaaaaaaaattttactgaagtatgaattttatcaggttaaaaagagccttagctctagatttaagagcataattgctgggtcatatgtgtatggctccagcttggatggaaagttctgaattgttctccaacactcccactgcaaccccaccacacattattccatagtctgccaacacttgatggtgtgaggctctctgcttgttcccaacctgacgactataaaatgatatctcgaccaggcgcggtggctcatgcctgtaatcccagcactttggaaggccgaggtgggtggatcacctgaggtcaggagttcgcgaccagcctggccaacatggcaaaaccccgtctctactaaaaatacaaaaattagccaggcatggtggttcattcctgtaatctgagctacttgagggggctgaggcaggagaattgcttgaacctgggaggcggaggttgcagtgagctgagatcacgccactgcactctagcctgggcaacagagcaagactccatctaaaacaaaaaataaataaataaaatgatatcttatgatggttttaacttgacttttcctgattattagtgaaatttccatttgtcttttatgataatttttatgttgtctttttcttatacatatatattctggattagtcccttaggagagttagatgtgttgcaaatagcttctcctagtttatgcagattttttacttttcttttttttttttagtatgtcttttgatcagtagaagttttatattttaatctcgttcagtttattagtcttctcctttatagttggtgcttaggttttgaaatatcaagtaccttttggtaatttttcaacagcttagcttatatggcacaatgcatttcatatgtacatatacaaatgtcaaaattataaatatgcctaaattatacatctgtaactagccttaaatattgtaattaaaactgtataattaaactaagcatgcaagccaatagtttaaaaaagagtttcactccagtttggtactgatttagctcttgagctattgaaatcaatggccagcatatgaagcaattatctgacgcttgtgggtggtgaccttgcagcagctcagcctcttctttcatttcatcctatttttgtccttaatagcagatatttatctcagtttaaaattttattattttctttataactacaatcttaacagtttaaaatagtactaaatttcatgtggaaagaaacttcagattctcagcaccttatcttccttagcgatttccactctagccctcaatgttattaggtaaactcttatctcaattgttgttttcactgagtgctatctaaccataatgaaaaagggaaaaaaaatagagtccgaattatccataactgcctctgctttctgagaaaggcaacgtgattctttttcagtggaggaaaaacctctctatggacttttttcaccccataacagagagattagtgggagaaagagaagagcttgagattcctgtctatcagggcctttggaaattcaaattgtgtcccagagctgaattctccaaaagaatgtacagagatttggaggtgcgggggagagagggctaaatagtttggcgggaggctggaagctgagctggtagatagggtcagaagactttttaagaacaaagactggagacttgaggtgactccatcttcactattacttcagatctttcttataatgtgcttcataaacacacaccttgtgtgaaagctgcttttgagaaaaagaaacgtattttatgcgacgcagggtgcaacaggagcggcgcatgtggggcagtgagaaattccttcccctgacccgattcagcagtgaaggtgatcagagcaaataggaactggactgcttcacgctcctcaaggactttaaggagtgtgtcttccaccacccacagcaaagggctcagaaaattttatctgaacctcctgacatctgagttatacaaactaagacaaagaatgggaagcacatagcagccactggtccattacagttctaaagtccagccaggcgcgtatttacccgagatagaaaatgttccttagtcagggtctagtactgctcactggaagtaattccccgatccactctttttttgaggctctttagttcatcctctgtgctcttggctctgccctccaagttgtccttcattttcattagaagtagctttcacaatctgctgcttgcccctaaaaactggggacccagagagttcatttcattttgaaataatgtccctgctccatttagttagagctggctttagcaagtatgcagcaggggactaatatccagaatttagaaggaattcaaatgactcaacgacaacaacaaaccaataattccattaaaaagtgggcaaaggacatgaatagacatttttactttcttttttgtttgtttgcttttgagacagagtctcactctgtcacccaggctggagtgcagtcgggtgatcttggctcactgcaacctctgcctcccggactcaagcaattctcctgcctcagcctcccatgtagctgggaccagaggtgtgtgccaccacgcttggctaatttttgtattttcttcttagttagagatggggttccgctgtattggccaggctgatctcgaactcctagttaagtggtccacccgcctcggcctaaagtgctgggattacaggagtgagccatcgtggccggccaaatagacatttttcaaaagaagacacacaaatgaccaacaagcatatgaaaacatgcttaacatcactagttatcagagaaatgcaaattaaaaccaaatgagatatcatcttacaccaatcaaaatggctattattattattattttgagatggagtcttgctctgttgcccaggctggagtgcaatggtgcaatctcagctcactgcaacccacgcctccccggttcaagcaaatcccctccttcagcctccctagtagctgagattacaggagtgccccaccacgcctggctaatttttgtatttttagtagagacggggtttcaccatgctggccaggctggtcttgaactcctgaccttgtgatccaccagcctcggcctcccaaagtgctaggattacaggtgtgagccatggcgcccagcccagaatggctattattaaaaagacaaaaagtggcagatgttggtgaggatgtggagaaaagggaatggcttacacattgctggcagaaatgttaattagtacaacctctatggaaaacatcatggagatttctcaaagaaataaaaatagaactacaattcgatccagcagtttcgctactgggtatctacacagagtaaagaaatcattttataaaaaaagatacctgtactcatgtatatcacagcactcttcacaatagcatagatatcagcctaagtgtccatcaacaaatgataggtaaaagaaaatatttgtctatatacacaatggaatgctattcagccataaaaaagaatgaaatgatgtcttttgcagcaacgtggatggaactggaggctatgatcttaagtgaaacaactcagaaacagaaagtcaagtactgcatgttttctctcataagtgggagctaaccggtgggtaaacatggatattgagtatggatgatagacagtggagattaggaagggtggtgagatagggagagagaatgataaatcacttggtggtacaacctatgttatttgggtgatgggtaacctaaaagctccgactccaccactacacaatgtattcatctaacaaaattgtaccacataaatatatacacattttaaaaatttaaaaaaaagttctgagttcttgttgagtcttattgaggatcacaccatagcagaaggactacatccataattctttctaagatgcgcttttctgtactttgggccacatgtgaggctgctatggtaaatgctcttaagattcttagaagtccaactgtctagttgagaaagtctactaggtgctgccttaaatcttatagaagttttaataagggatcttggctgggcacagtggctcacacctgtgatcccaacactttgggaggccgaggcgggtggatcacctgaggtcaggggttcgaaaccagcctggccaacatggcgaaaccccgtgtctactaaaaatacaaaaattagctgggcatggtggcacatgcctataatcccaggactcaggaaactgaggcaggagaatcgcttgaacccaggaggcaaagttttcagtgagccaagttcatgccactgcactccagcctgggcaacagagtgagactccatctcaaaaaaaaaaaaaaaaaagatgggcattttaccttattaaaatagtaatcataagggagcttatagacaaaccttttttttaatgtttacttaccttggccatttcttactttgagaatgttttgctggccggagatgctgtcctgggccctctgtttcttcttactgctgcctaaaacctaaagagttctttctttccattcatctctttcttcctgcactttatcttcctgcactttactaaaacctaaagagttctttctttccattcatctctttcttcctgcactttatcttcctgcactttactaaaacctaaagagttctttctttccattcatctctttcttcctgcactttatcttcctgcactttactaaaacctaaagagttctttctttccattcatctctttcttcctgcactttattctgcactttcttcctgcactttgtaactttcttcctgcacttcatcactttcttcctgcacttcctgcactctccattcatctctttcttcctgcacttttaacacaggtaaaagaagccaattgtactttcaatattttacctaaaaatctccttattcagatcaagttcattagctatattttatttctgtctttcatgacattacaggtgacaatgtggccaaaaatctcactactatgtaacatcttttgtcacgcttccaaaagcaattttctcactgctattgcaggcttcctaacaatttcctcactgcccttctagcctctgctgcctcccaatatcagagccaatgacaaatgttttagggtttggttatggcagtatcccacttccagatagcaatttctgtttcaattatctactgctgtgtcataaacccgcccagcatttagtggcttaaatcaatatccattttattgctcacaattctgtgggtcaggaatttgggtgagggctgatggcaacagctcatctcagctccagtggggctaactgggaaagatccaagctgtcggccggctcgggcaccttgattctcctgtctgtggcctctcatcatccagaccctgttcctttccatgtagcgtctccaacaggacacgctggacttctttacacaccagctggcttccaagaaggcagaaacagaaactgctaggcctcttatggcctaggcccagaagtcacaatgccacttccagagctttctgttggttagatcaagtcatgaagccaatctatattcaagggaaggggaaagatatttcatttctttgctgggaatgatacatcacaaaacagcatgcaggataggatggattggggtgaccatttttagaaaggacctacctctcagaaagaggcaaaaattcatgaactgaaatactctctgagacaatctctattttatagtctagcaataaaccagaagttcaagctctgctctctggctatgtaagcaaactgaggtcagaaaggagttcaagcaacaacgaattgatacaaggctgctgttacaagattctcatctatagtggtttggtctttgctcgagcattttgagagacaaactgcctccaaaggagacctgttccacaattgaataattctaaagtctataacaatcttccatttgcaaagttcaacattgcctttctgtgactcctcccatggtcagatatctgccctccaaggccactgaaagaaaggctactccctcctcaatatggcattcatttaaatctaaatattttcagacacttttcttgactcaagacttcctaacttctttacctgtctatcatgttaagtcattatttcccagaaacatgtgtttatgtataacacatacaatccatagaataaaatttgcccagaatagtatgtttaagaggaaagaaaagtatgtaatagattattgaaagtttcaaaatatctggtggtacaatgagtgagttaaacatttatctggcttaaccattcagtttgatcttgtggaaatccagtgcttggaacttatcttgtcctaactttttcataacatagtcactgtttacctgaataattgtctaaatgtagtgtcctttatggttggttagtattcactgggtgatggggaaaagaaatacataaatcctgagaaaagctgaaagcaaagtttattcttacaaatgacaaaaaatgcccagatacaacagactctctgtttgatgtgtgtgtgccagaatgaaaactatgggtctgaggcaccttctttttaaaaaaaaaaaaatttttatttgcataggtttttggggaacaagtgatatttgagtacatgagtaaattctttagtggtgatttgtgagcttttggtgcacccatcatctgagcagtatatactgcgcccagcgtgtagtcttttatccctcaccccctttccacactttgtccctgagtccccaaagtccaatgtatcattcttatgcctttgcatcctgaggcaccttcttccataagcaccatccagaaggagaagtggttcttcaactatggctgatgggagcaaagtgctgaagcaactatgactggttgaaagaccatttctcctgtgaatggtgcttatggaagaaggtgccttagacccaaaactagagtgaggcttttattggttggggaaggtggctataaaaagataagaataatgaaaagctatgaccaattaaaaaaaatgagaacttaatcacagccttatcgacccacaaccaggggtccacaaatagccttaattatgacttatgttattaagataacaaccccaaattttccgggcagcaattttttggtgccaatattttggtcttttgcttccaaagactagccttttgataaagtcagacagctctaaaatgtatgtgtttaagttctataaatagacatacatttgaggatatatgaaaggagcaaagtatttatctcaccacacagttaagaattttaaaaacattcattgttggatagtgatttttaaaacattaaaataagtggaacgattgctttgaatttatgaagaataacacatataattaatgacttttctatttgtattatacttgcttagatggttcaggcttagtaagaaagctattgatagtagaaaacaatgtgtatatgtaataataaagaaataacgtggattgttagtgaatagaaaatagtccttttggccaggtgtggtggcttatgcctgtaatcccagtactttggaaggccaaggcaggaggatcacttgagccaagcagttcgagaccagtctggttagcatagtgataccctgtctctacacaaaattaaagtaaaaaaattatctgggggtggtggcgcacacctgtggtcccagctacttgggaggctgaagtgggaggatcccttgagcccaagaggttgaggctgtagtgagccttgattgtaccactgcactccagcctgggtaacagagtgaaatcctgtctcagaaagaaagaatgaaaaaaagaaagaaagagagagagagagagagaaagaaagaaaggaaagaaagaaagaaagaaagaaagaaagggaaagaaagagagagagagaaggagggagggaaggagggaaggaaggaaggaaagaaagaaggaaggaagggaggaagggaggaagggaggaagggagggagggaggagggaaggaaggaagaaagaaagaagtggatatgttttggatgtttatcccctccaaatctcatgttgaactgtaatcccccatactggaggtgggacctggtgggatgtgttggatcgtgggagcagatccctcgtgaatgacttagtgccatccccttgataatgagtgagttcttgttcagttggttcacgtgagatctggttgtttaaaagagtctgggacctcccccttctctctctctctcactctctctctcaccgcgtgaccctgcgtgccctgatttaaagcttcctgaggcctcaccagaagctgagcagatgctggtgctgtgcttgtacagcctgcagaaactgaaccaaaaaaacctcttttctttagaaattacccaccctcaggtattcctttatagcaatgaaaatggcctaacacaatagtcttttgactatatttagtttgaagatagttccagatatttccctacattactttctcatctttagtgagcaaatggtatactgaaactagatagtgatggtggtgcgacaatgtgcgtgtactaaatgtctctggattgtacacttaaaatggttaaagtggtaaattttatgttatgtatattttaccaccacaacaaaaaaaacctttcttttttttttttttctttttttttttatttgagatggagtcttgctctgtcgcccaggctggagtgcagtggcacgatctcagctcactgcaacctttgcctcccaggttcaagtgattctcctgccttagcctccccagtacctgggattacaggcacacaccaccatgcccggtttatttttgtatttttttagtagagtcggggtttcaccatgttggccaggctagtcttgaactcctgaccttatgatctgcccgcctctgcctcccaaagtgctgggattacaggtgtgagccaccacacctgaccaaaaataacctttcaaaacaaacaaaccaacaaaaaacacccatagttcacctaaatatgcctgaaaatgtactttgcagggaacctaaaatctgggatttgaagtaaaaaaggataaccccaagttgaatttgttaagattgcccaccttttctttgctgacaactggcaaatggtttgctaacttctgggcagatgagagttcagtcagcacaatcaacaaagaagtgacgttcactcgggcccaggcaggcctatgtgctgggagcttttggaccttaaattggtctgagttcactgttgctccagttgcagacaggagcaggcaggttcaagagtttctgatgctttgctgtccagcagtcagctgaccatgagcacagccggcacaagcagccctttatgctggtgagaatcctgccagcagtgctgaggcacaatccctcctttatgtgttccctttgcacatttgtattcttggggcctttgggatttttgttgctgcagataatgggaaatgggtgtcggtgggtgttacgagcagggttttcagtagactaggaagaacaactggttaaaaataaaataacaatagtgacaaataggaaaggtgggcaacctcaggcagtacagctcctgagcaaatgcttccagcttttaccctaaaacataagcaactgggcacaactccaggccttgactgtctcattggctgataggaataactactaggaactattaagattacctgatattctggccttttcataattacagtgcagcctagttgatgttgttggaacatgatggttctttgatagaaaagtctctactttcattacaaatggaaagtgcaaatcagaagggtttgtaccatttggggttaggatccaaaacatttgttccaccaagggggaaaaggtccaactacaacaagttatcttgagattgtccagggtgttctctaaagccctaaatccaaaacttttccttttttgaggcagactctcactctgttacccaggctggagtgcagtggttccatctcggctcactgcagcctccgcctcccaggttcaggtgattcccctgcctcagcctcccgagcagctgggattacagacgtgtgccaccacgcctggctaattttttgtatttttattagagacgcggtttcaccatgttgtccaggctagtctcgaactcctgatctcaagtgatctgctggtcttggcctcccaaagtgttgggattccaggcgtgagccatcatgcatggcccctgcatctgaaactttaatgtgcatgcggattcaaatggggatcttgtcaaaatacagtttctgattttgaagattttgcatttcttttttttatttttatttttattttattttttatctttgagatggagtctcgctctgtcgcccaggctggagtgcagtggaacaatcttggctcactgcaagctctgcctcctgggttcacgccattctcctgcctcagcctcccaagtagctgggactacaggcgcccgccaccacatctggctaattttgtgtatttttagtagagacggggttttacagtgttagccaggatggtctcgatctcctgacatcgtgatccgcccgccttggcctcccaaagtgctgggattacaggcgtgaaccaccacgcccggccgaaaattttgcatttctaacaaggtttcagggagtactgatgctgcaggtctgaggaccacacttcaagttgcaaggctgtcaggaagtgagagctagctagggggaaactagcatcatttcagttaggtctagtattgctgctaatttactgaaagttttaaaatgtagcttttctgtaaagaaacaaacaggacattctaactaaacaaagtgctgtgaaatcagtcattcacactgggtagctagagctactgtgtctcaactggaggaggcaccatctccagtggatcatttagaaacgtagagggtggctactggtatttggtgcctgggggcccagggcactaaatgtctggtaatgtgtggaagagttctgcacaaataattgtcccactcaaaacgccaagagagcccccctgccccgccccattcaggtacccgagctacaccagtggagatggaggctgcacccatacctgagacctcagccaatcaattctatggccatctccttgagtgtgtcatctggaatagaagatcctgcccatgtattgtagctcatctctttagaactttgactgcccttggaattctccagtgggaagagtggcctctgtctagtgtaccacatgtggttccatagcttgatgtattctctcagcaaaggatgagatcgacaggaaaggcttcaggaagccctacggaatttggattcatcaacattttgaatcaaaaatcagaaaagggaacatccagtgttccccttgagacgataccctcaagtgctgctggtgctcacctcctaaactcctaaacggggctgtgaccagcttgcctagtgccaacgacaacagctccaaggcatctgggcctatcaaacttccactgcgttcttttccacaaaagaaagaatcccacagcgctagatttgctggccatcatgtcaaacaaactctgacctctgatcccaacacagtgttgaacattacaatgaggatgttagaaattctgctggagactgagttgaggtaaaaatagatacaggggctgggcatggtggctcacacctgtaatcccagcgtgttgggaggctgaggtggaaggattacttgaggccaggagtttaagaccagcctgggcagcatagcaagaccctgtctctaaaaaaaaaaaatttttttttttaattagctgtgtgtgtttccacgtgcctgtaatcccaactactcgagaggctgaggcgggaggattgcttggtcccagaagttggaggagtgcaatgagctgtgatcccgccactgcactccagcttggtcaacagagcaagaccacatctctaaaaacaaagacacagatatgagaaataaaatagggatgaaaggaatgagttaagacaatgttagagaaggatgacgtagtaagaaacctgaagataacgaaaacccacattaacctaatgttgcagaaaagagggcttcatcattgttgtctgagaaacttgtgagtaaaagacaaaaataatacatattgtgagaaatacattcaatacaatataaggaaaatattctttagcttcttgagactccatgaagttcaagagttaggaaattctgaaaagggtttggcagggtcatagtgattccgtctggaaagggtttgtttgtgcttggtctcagggctgctaggaagatgggaaatgtctctggcactccaggagagcaattactctgtgccatgacttcatgtgccccctcaccatgatgcagtgccccatgggagatgttctgtcactgatcccactgtctcactacattccaacagtccaaaagacaggcaaaaatttagactgataactttttttattagtctgatttaaaaattagttacacaagtaaaataatgtctgtatcacactcataatcacgtgtgcacatgaaaatgttagctcagaggaggttgaatgcttctccagtgcagacttcctggaaagctggaaagctgggcaatggctcaggggcccctgggcacagcactgtcttctcctgaatgagaatcagctgtgctgatgcctacgttagttcaagaaccaggagctgcataaacaagcttttgagaagtatgccagaagaagctcagattgatgatggtgtgtttgacaaaattaatgaagccatgcttattagactgaaagataagattccaaatgtgagaatacaggcagttctggcgctttcacgacttcaggatccaaaggatgatgaatgcccagtggttaatgcatatgctactttgatcgaaaatgattgatttgaatccagaacttagacaggcagtgttatcatgtattgcaccatcagcaaagactttgccaaaaattgtagggtgcaccaaggatgtgaaagaggctgtcagaaagctggcttatccggtgttagctgaaaaggttcgtatgagagctatgtccattgctcagacagtaatgctccctcaacaaggttttaatgagagatgagatgctgtgaaacaagctatgtggaagcatcttctccaaagctggttatggttctctgagggaaatatcttcgagtggcttcagcagttggatgtagaaaattctgaagtggcagtctctgtcctcaatgccatgttttcaatgactcctctcagtgaactggtggcaatctgtaaaaacaatgatggcaggtacataaaggattcattctttgaaatgtaatactgattaacttctacaattaatttgttttttttcctccccatagcttaagattatattaatatctttaatcttacctcccttttgttttcttttagtctgatgaatatcttctttcccttcttttttcccctcctggtgtaagaactcattactttatcttagactatctactttagctgtggttttctacccctcggtttcttactttgatttttgaattagcctaccatgagaaaatccagcaacatgcacccctagtatatgtttgcttatttggttcttttttgttctaagttccttcattcctttctgtgttaatgactctaattaaaaggatagtggttttaaagcaaatcttcttattcttatttatgttctcttcaatttgtaatgatataaagatcatgctttctcttacactctttcttttaagtgaaggaaattgattctagtggaaacgttaactcctgaaattgctttgtattggtgtgccctttgtgaatatttgaaatcaaaaggagatgaaggtgaagaatttttagagcggatttcgccagagcctgtagtatatatagactatttactgaggtaaatttttttttcttttagtttggagaatgcttgtgttgctgcaactgttaacctcccagcccccttcctcgaggtcatgcttgattgtgaatatgttaaaaatcctttttttttttttgtacatgccgggatagttatatacattgagtctttttgaatatcttgtatatcttgtgctggtctgtataatgaaagagcaaatcatgtttaggatcatttcttcaaaactattaagatatgattatgaacatttctgcatatacagttgataatgatgatgtattatttctgaaattggttggcacattttctgttaagtgccagataataagtatcttagggtcttgtgggccataccatctgtcaaaaacaaaaacaaaaaacaaaaaagaccaggagctggttggacatttgtgaatgttctcttgccctacttcgactctcacttctcttaagttctgtacctcgactacacaaatcagaggctgccagcagatggatgtgtgcacgtgtgtgtatgaatgtacttcctgtccacctggaacttacctgcaaaaatccttgccacaatttggatgtgcagagaaagtgttgtttcttattttctttatatcctttcttgccttcctcaggtactacctattaccagcaggaaaacaaagcaaacaaaccaacagaacccaggaaaatggaaatggcccacctgatttaagctttagacatacacaatactttattgtacataagtgtcaaatgaaattaaaaacgaggaaaaaaagacatacacaagactttaaatggctccgtgggcactgtccagccctcagcttggatccgtctggctatccttgtatgtggtggcattgctttgggtgtcagggacgcccttggctgcttggcttctggactccctgcttacttatgagctcaggcctggggctggggggttcatggtgggacccgtgggcacaggaaccactcttgtggggcatagcccccaatggacccagattagacccctctaagtgcctgtagtgccatccatgcaaccacctccagccctgcctcagcctgacctcgctctagcaccatggacttggggcccacccagcggctctcagccacccctttcatgctgggactttgtgagggacactcagcacctacatcaggctgatcgcctcgccagactcttcctgctctttttttatccaccacgctgtagactgccgaggtagacttttctttacatttcctctgtgacatcttccccctaccacttcagagaaagccctgaggcccagcaggtccagcagatggatggaaggactctcttcatctccactgtaagaaatggtttaagctgcaaggcatacctagaccattcaaatagcagctgaaagaatccaccaaatccacaaagcacggatttcaagcctagcctcttgacaagagagaacatacctgctctcggccccaggcaataaaccccttgacttgattttgagatgaaagaggctagaaggaaatgtggcataaggacaaaaggcactggttaaatatttgtagactattctttccattaccactgttctatagagtcttgaggagaaaacaagacaaagcaacaaataattatataattcagtagctgcaatagataaagagaaccattaaaagaataggttttctcaattataaaatgaggcattaaccaaattttgaatattaactatatatttgactattcctggacaactagaaggctggcgattgtacatgcatttgtatttgccagttgtgtgtcttcctcctttcaacctcacacagctaatttatgttgaccctcaaaaaagaaaatgagtacttgaatgtcaaggcatgtgactttcattctaggacatatagtaacttccagagcactgagtcagcagtctaaaggtttagccttcatactcctgacagctgtttatttctttcagtgtaatttcagagaaacatatccagaagggatttgctgccctagatctatcagaaaacatatttaagatattctgtagttttatagcacaaaaatctaacactaaataatcacatcataacagggtttcaatttctgtaataatttatcttaaatcaggcacaagggtatttaaagcacacaactaatactttgtagagatttaatgagatgatgtatgggagcagtaggggctgagacatttgtttccagtactattttaaagcaataagagaataatagcatttgaaataacctttccaatctattggattcaggcttctgccttctgtatctaaaaagaagcttagtcactggcttctggtagatgagtaggacttctcaaagatcaggaaggcttggggtcatagctggtgatgcataaagggccccaggtcaagaagtctaagcccatcaggctcagattgaaaccaggaacctgagcgacaggccaaattgggacttaggaggtcctctaggcaaaatcagtccctgaaaaggaagattggagcagaaaccagtggctccagcaggtgggagagagcagacagcagttttcatccacaaggtaactggttgctttgatagcagctctgcctccctaagtgcttcagatatgaagcaactcctaagaaaagaactagaattaaaactatcaaaaattacaagaattaaaataatagagtagaaagtatctatttattacaaaagaaagcaatgaaaaggaatagtcacgagactaacaaaatgaagtcatgagcatgacaaataaatattgaaatggcagatataatttcaaccatacaaataataacattaaatgtgaatggattagacaccccaatcaaacgacagagattgttaagactggatttttttttttttttttgagatggaatcttgctctgtcgcccaggctggagtgcagtggtgcgatctcggctcactgccagctctgcctcccgagttcaagcaattctctgcctcagcctcctgagtagctgggattataggcgccccaccaccacgcccggctaatcttttgtatttttagtagagacagagtttcaccatcttggccaggctggtcttgaactcctgacctcgtgatccacccgcctcggccccccaaagtgctgggattaccggcgtgagccaccgcgtctggccaaggctggattttttaaaacaagacccacctagcagggtgtggtggctcacgcctgtcatcctagcactttggaaggccgaggcgggtggattgcctgagctcaggacttcgagaccagcctgggcaacacggtgaaaccccatctctaataaaatacaaaaaattagcccggcatggcggcgggcgcctgtagttccagctacttgggaggctgaggcaggagaatcacttgaaccctagaggtggaagttgcagtgagctaggatcgcaccactgcactccaggctgggcgacagagcaaggctctgtctccaaaaaaaaaaaaaggccgggtgtggtggctcacgcctgtagttccagcactttgcgaggccaaagagggtggatcacgaggtcaggagatcgagaccatcctggctaacacggtgaaaccccgtctctactaaaaaaattagccgggtgtggtggcgggcgcctgtggtcccagctactctggaggctgaggcaggagaatggcgtgaacccgggaggcggagcttgcagtgagcccagatggagccactgcacttcggcctggatgacagagcaagactccgtctcaaaaaaaaaaaaaaaaaaatcaaaaaacaagacccacctagtatgtgctctttaaaagagacgtgactttgattcaaagagtttcgagataaaaggatggtaaagatatctcatgcaagcattaactttgggagagccaaagtggctgtactaatatcagagaaaatttaaacacaaaggaattacttaatttaaaaaaaatttaagtgcatagtttagattaggaaatcaatctttgtggtgcgcagtactatgggttttggcaagtgcatagtgtcatgtatccaccattacagtactgtacacagtcgttttaccatgccccaaatgccttctggtacaactattcattcttcccgttccccagtccctgagcttctggcaaccactgatctttttcactgtctatgattttgcgttttccagactgtcaaacagtattgttgccttttcagactggcttcttttacttagcaatatacatttaaggttccttcatgttttcgtaatagctattgacagctcatttatctttatcactgaataatattccattatatgaatataccacagtttttatccattcacttgttgaaggacatcttggttgtttccaagttttggcaattatgaataaagctgctataaacatttgtgtgcaggttttggtgtaggcatatgttttcagttcatttgggtaaataccaagtagcatgatggctggatcatatggtaagagtatgttagcgtttgtaagaaactgtcaaactgtcttccaaaatagctgtaccattttacattcccaccagcaacgaaagagagttcccattgttccacatacttgctatcatttgatgttgttagtgttttggattttgggcattctaataggtgtgtagtggtagctcattgttgttttaatttgcagttgtcttatgacatattatgtcgagcatcttttcattgcttatttgctgtctgtatatcttcttaggtgaggcgtctgtttagatcttttgtctatttaaaaattaggttgttcattttcttattgttgagttttaagagttctttgtatattttagatacagtcctttattcaatatgtcttttgtaaatattttatcccagtttctcattctcttgacagtgtctttcacagagtagaagtttgtaattttagtgaagtccagtttattaatttgttccttcatggatcatgcctttgtgttctaaccaaagagttattaccattccgaaggtcacctaggtctgctcctaagttttgcattttacatttaggcctatgattcactttggggtaatttttgtgaaggatataaagtccgtgtctagatgcacttttttttgcatttggatgtgtagttgttaagcaccttttgttaaaaagatggcccggtgtggtggctcacacctgtaatcccagcactttgggaggccgaggtgggcagatcacaaggtcaggagttcgagaccagcctggccaatatggtgaaaccccatctctattaaaaatacgaaaattagctgggtgtggtggtgcatgcctgtaatcccagctactggggaggctgaggcaggaggatggcttgaacccaggaggcagaggttgcagtgactgagatcgcaccactgcactgcagtctgggtgacagagcgagactctgtctcaagagaaaaaaaaaagagagagagagagaaagagaggacattggggcctataggcacaggccaccatgcctggctaatttttgtattttttgcagagatgaggtgtcgccatgttgtccaggctggtctcaaacttctaggctcaagtgacttgcctgcctcggcctcccaaagtgctaggattacaggtgtgagccaccacacccagactgttgagaatttttgtgtttatgtctgtgaaaaacattggtgtgtgattttgattttttgtaatgcctgtgtctggtttttatactagggttatgctggccacatggaatgatttaggaactattccctctgtttctattttctagaagagattgtaatgaattggtatatttattccttaaatgtttgatagaattcactaacgaacccatctgggcttggcgcttactgatttgaaggttatttgttgttgttgtttttccaactttgttgagatataattggcattaaaaaaactgcatatggcctggcatgagggctcatgcctgtaatcccagcaatttgggaggccgaggcaggaggattgcttgaggcttggagtttgtgaccagtgtgggtagcatagtgagatcctgtctttattaaaaaaatttcaagataaattagctgggtgtgatggcacgcgcctgtagtcccagctactgaggagattgaggcaggaagattgcttgagaccaggcatttgaggctgcagtaagctatgatcaaaccactgcagtccagcctaggtgacagagagagacactgtctctaaaaacaaaaaaatccaaaacaaaaatctcccccaaaaaactgcatataaatttatgcatacaatttgatgattctggacatatgtatatattcatgttgctattgctgtaatccaggtaatacacgtatctgcaactttccccgtgtcccctcttttttttcttcataagaacacttaacatgagatctaccctgttaacaattgtttttacgacacaatatcttgttgttagctatggacagtctattgtacagcagatctctggaactcaccgatcttgtttaactataactttatacccactggataacaactccttttttctccttcatgccatccccaggtaaccctcgttctgttgtctaattcaacacctttgactattttagatgctcatattagaggaatcattagtatttctctctctgtgactgaattatttcacttagcgtcatgtcttccgggtccttccacgttgtgacaaatggtaagatttccttctttttaaaggttgagtaacgttgtgttgtatgtctatgtcacattttctttatccattcagctgtctatgaacatttgggttgtttctacatcttggctattgtaaataatgctgcagtgaacacaggaatgcataaatattttctcccattctgcggggttgcttttcaccccgcggattgtctcctttgctgtgaaaaagctgtttagtttgatgtaatcaaacttttctatttttgcttttgttgcttgtgcttttgatgtcatatccaagaagattattgccctgaacaatgtccaaaagcttttccttgggtttattctagtagttttacagtttcaggtcttacgtttaaatctttaatctattttgagttgattctcatatatggtgtgagataaggtccaatttcattattctgcatgttgctattcacttttcctggtaccacttattgaggagactatctttttctgcattgtgggttcttggcacacttgtcaaagatcagttgaccatagatgtgtggatttatttctaggctctctattctgttccattggtctgtctgcctgatttttattccagtacaacactgattactgtagctttataatatattttgaaatcagtaagtacgatgcctccagctgtgttcttcttgcttaatattgcttcagctatttgggatttcttgtggttctatattttttgagatttttttcctctttctgtaaaaaaatgtttaccgtattttgatagggcttgcactgaatctgtagattgctttgagtagtatggacatcttaccaatattaagtcttctaatccatgaacaagagatgtcttcccatttatttgtatctgtcttaatttctttaatcattgcttcatagatttcagtgtgcagtctttcacctctttggttagggttattcctaatattttatctttttggtgccattataattaggattgtcttctttttttaatatactagttggccacatagatatcttcttttgagaaatgtctattcatgtcctttgccaattttttaacggagttttttgttttctgcctaatttaagttccctacagaatctggatattagacctttcccagatgcataatttgcaaatattttctcccactatttactctgttgatagtttcttttgctgcaggatgctctttagtttaattaggtccccatttgtctatttttggttttgtttcaattgcttttggcatctttgtcatgaaatcttagccagggcctatgtccacaatggtatatctcaggttttcttccagggattttatatttttaggtttttcattcaaatttttaattcatcttgagttgatttttgtgtatggtgaaaggaaggagtccagtttcaatcttttgcctatgcctaaccagttatcccagcatcatttattgaatagggagtcctttccctattacttgtttttgctaattttgttaaagatcagacggttgtagctgtgccgctttatctctgggtcctttgttctgctctttttttcttcgagtctatttttgtaccagtatcatggtgttttggtttctacaaccttgtagtaaagtgtgaagtcaggtaataggatgcctccagctttgttctttttgcttaggattgctttggctattcgggctcattttggttccatatgagtttttaaatagttttgtataattctgtgaataatgtcattggtagtttgataggaatagcattgagtctgcaaattgctttgggcaatatgacaattttgacaatatttattcttcctatccttgagcatggcatgtttttctatttgtttgtgtcatctctgatttctttcagcaattattcagtaattcagtaattattattgtagagacctttcacctctgtggttagctgtattctgaggtattttactttttgtgtgtctattgtaaatggcattgcattcttgatttggtgttactggtgtaaagaaatgctactgatatttatacattgattttatatccttaaactttggtgaagtagtttatcagttctgggagctttggggcgaagactatggggtttgctaagtataaaatcatattgtttgcaaggagagatggtttgactacctcttttgctgtatggatgctttttatttctttctcttgcctgattgctctggctaggaatttcagtactatgttgaataggagtggtgggagtgggcatccttgtctcgttctggttcccaaggggaaggcttgcagctttggcccattcagtatgatgttggctgtgggtttgtcatagacagctcttactattttgaggtatgttccttcaatgcctagtttgttgagggcttttaacatgaagggaggtttaattttgtcaaaagacttttctgcatctattgagatgatcatgtggtttttgtctttagttctgtttatgtaatgaattacatttattgatttgtgtatgttgaaccaaacttgcatcccagggataaagcctactttatagtgctggatttgttttttgatgtgctgctgaattcagtttaccattattttattgagggattttgcatctatgttcatcagggatattggcctgaagtttcccctttttgttgtgcctccaccaggttttggtatcggaatgatgccagcttcatagaatgagctaaggaggtgtctctcctcctcaattttttggaatagttttagtagaattggtaccagctcttctttatacatctggtagaatctttctggcccaggaccctctctggttggtaggctttttattactgattcagtttcagaacttgttactgatctgttctggttttaatttcttctggattaaatcttgggaagttgtttccgagaaatttatccatttttctaggttttctagtttgtgtggtaatgtcccctttgtcatttctgactgtgtttatttggatcttttctcttctttcctttattagtttaggctagtggtctatcgatcttatttattcttgcaaaaaaaccaacttttggtatcgttgaccttttgtgtgttttattgtgtctcaatttctttcagtttggctttgatttttgttttcttttcttctgctagctttacggttagtttgctcttgtttttctagttcctctaggtgtgttaagttgttcatttgaggtctttctaactttttgatgtgggcacttagcactataaagtttcttcttcacactgcattagctgtttcccagagattctagtatgttgtatctctgtcttcattcgtttccaagaatttcttgatttctgccttaatttcattgtttacccaaagtcattcaggagtagattgtttaatttccatgtaattgtatagttttgagcaatcttctaagtattgatttctatttttattgtgctgtggtctgagagtgtggttggtatgattttgtgttttatgaatttgttgagcattgttttatggtcgagcgtgtggttggtttttcagtatgtgccacctgcagatgagaagaatgtaatgtatagtctgttgttggctggagtgttccgtagatgtctgttaggcccatttggtcaagtgtcgagttcaggtcttgaaaatctttgtcagttttctgccttgatgatctaatactgtcagtggagtgttgaagtcttccactatttttgtgaggttatctaacaaaataggtctctaagagcttgttttatgaatccagtgctccagtgttggatgcatgtgtatttaggatagtaaagtcttgtggaaattaaaccctttatcattaagtaatgcctatctttgtcttattttattgttattgatttaaaatctgtgttgtctaaaattagaaaaggaacccctgctcttttttctttccatttacttggtaggtttttctctatccctttactttaagcctatgggtctcattgcatgtgaggtggatcctctgaagacagcataaagttaggtcttgtttctttatccattttgccactctgtgtcttttaagtggaggatttagcctatttacattcaaggttaatattgatatgtgcgatttgatcctgctgttgtgttgttagctggttgattgtatagttgttttatagcatcaatggtctatgtacttaagtgtgtttttgtggtggccagtaacagtgtttcatttccatgtttcgcactcccttaagggcctcttgtaaggcaggtctggtggcaatgaattcccttagcatttgcttgtctacaaaggatcttatttctccttcactcatgaagcttagtctggctggatatgaaattcttcgttggaacttcttttctttaagaatgccaaatataggaccccaatctcttctggcttaagggtttctgctgaaaggcccactgtcaacctgatggggttccctttgcaggtgtcctgccccttttctctagctgcttttaatattttttctttcatattgatcttggagaatctgttgactatgtgatttggggatgattgacttgtatactatctcacaggaattctgtgcatttcctgaattctaatgttaacctttctagtgagttttgggaattttttaaaaatttatttaagttctcagatacatgtggagaacgtgcagatttgttacataggtacgcatgtgccatggtagtttgctgcacctatcaacccctcatctaagttttaggccccgcatgcattaggtatttctcctaatgctctctctcctcttccccgccgcccccgacaggtcccggtgtgtgatgctcccttccctctgtccatgtgttctcattgttcaactcccatttatgagtgagaacatgcagtgtttggttttctgttcctgtgctagtttgctgagaatgatggtttccagctgcatgcatgtacctgcaaaggacatgaactcattcttcttcatggctgcatgatagtccatggtgtgtatgtgccagattttctttatccagtctatcattgatgggcatttgggttggttccatgtctttgcaattgtaaatagtgctgcaataaacatacgtgtgcatgtgtctttatagtagaatgatttatattcctttgggtaaatatccagtaatgtgactgctgggtcaaatggtatttctcgttctagatcctcatggaattgccacactgtcttccacagtggttgaactaatttacactctcaccaacagtgcaaaaggtttcctatttctccacatcctctccagcatctgttgtttcctgaatttttaataatcaccattctaactggcatgagatggtatctcattgtggcatcaaatttgatggtatcaaaaagatttgcatcaaaacttgatgatagcaaaagatttgcatttctctaatgactagtgatgatgagtttttttcatatgtttgttagctgcataaatgtcttcttctttagagaactgtctgtacatatcctttgcttactttttgatgggattgtttgtttttttcttatacatttgtttaaattccttgtagattctgggtattggacctttgtcagatgggtagtttgcaaaaattttctcccattctgtaggttgcctgttcactctgatgatagtttctttcactgtgcagaaactctttagtttgattagatcccatttgtcaattttggcttttgtgcaattgcttttggtgttttagtcatgaagtctttgcccatgcctatgtcctgaatggtattgcctaggttttcttctagggtttttatggtttggggttttacatttaagtctttaatccatcttgagttaatttttgtataagttgtaagaatttgcatatgttgaaccagccttgcatcccagggatgaagctgacttgattgtggtggataagatttttgatgtgctgttggatttttttgccagtgttttattaaggattttctcattgatgttcatcagggatattggcctgaaattttgttttttttgttgtgtttctgacagcgtttggtatcaggatgatgctggcctcataaaataagttaggaggattccctcttttttgattgtttggaatagtttcagaaggaatggtactagctcctctttgtacctctggtagaattcggcagtgaatccatctcctgggctttttttggttggtaggctattaagtactgcttcaatttcagaacttgttattggtttattcagggattcgacttcttcctggtttagtcttgggagggtgtatgtgtccaggaatttatccatttcttctagattttctagtttatttgtgtagaagtgtttatagtattctctgatgatagtttgtatttttgtgggatcagtagtgatatcctctttatcattttttattgtgtctatttgacacaataaaatttatagataaatccatgaagatgagggaaaaacagcacaaaaaagctgaaaattccaaaaaccagaatgcctcttctcctccaaatgactgcaactcctctccaacaagggcacaaaactggatggagaatgacattgatgaattgacagaagtaggcttcagaaggtgggtaataacaaacacctctgagctaaaggagcatgttctaacccaatgcaaggaagctgagaaccttgacaaaaggctacaggaactgctaactagaatagccagtttagagaggaggataaatgacctgatggagccgaaaaacacagcacaagaacttcatgaagcatacacaaatatcaatagccaaattgatcaagcagaagaaaggattcagaaatcaaagatcaacttagtgaaatagtcatgaagacaagattagagaatgaagaatgaaaaggaatgaacaaagcctccaagaaatatgggacaatgtgaaaagaccgaatagactagtattgattgggggtccctgaaagtgatggggagaatggaaccacattggaaaacacacttcaggagaacttacccaacctagcaagacaggccaacatttaaattcaggaaatacagagaagtattgaggatactcctcaagaagtgcaaccccaagacacataatcatcaggttctccaaggttcaaactaaggaaaaaatgttaagggcagccagaaagaaaggtcaagttacctacaaagttaagcccatcagactaacagtggatctttctgcagaaaccctacaagccagaaaagagtgggggccaatattcaacactcttaaagaaaagaattttcaacccagcatttaatttaatagtcagccaaactaagcttcataagtgaaggagaaataaaatcctttacagacaagcaaatgctgagggattttgtcaccaccaggcctgccttacaagagctcctgaaggaagcactaaatatagaaaggaaaaactagtaccagccactgcaaaaacacaccaaatataaaaccaatgacactatgaagaaactgcatcaactaatgtgtgaaataaccagctagcatcataatgacaggatcaaatgcacacataacaatattaaccttaaatgtaaatgggctaaatgtcccaattaaaagacacagactggcaagctggataaagagtcaagacccatcggtgtgctgtattcaggagacccatttcacatgcaaagacacgcataggttcaaaataaagggatgggggaatatttaccaagcaaatggaaaggaaaaaaaaagcaggggttgcaatcctagtctctgataaaacagactttaaaccaaccaagataaaaaaagacaaagaagggcattacataatggtaaaaggatcaatgcaacaagaagagcttactatcctaaatatatgtgtgctcaatataggagcacccagattcataaaacaagttcctaaagacctataaagagacttagacccccaaatagtaatagtgggagactttaacaccccactgtcaatattagacagatcaatgagacagaaaattaacaaggatattcaggacttgaactcagatctggaccaagcagacctaatcaacatctacagaactctccaccccaaatcaacagagtataaattttctcagctgcacataacatgttttctaaaatcgactacataattggaagtaaaacactcctcagcaaatgcaaaagaatggaaatcataacaaacagtctctcataccacaatgcaatcaaattagaattcagaattaagaaactcactcaaaatggcacaactacatggaaattgaacaacctgctcctgaatgactactgggtaaataattaagttaagggagaagtaaagaagttctttgaaaccaatgggaacaaagagacaaagtaccagaatctctgggacacagctaaagcagtattaagagagaaatttataccactaaatgcccacaagagaaagctggaaagatctaaaactgacaccctaacatcacaattaaaagaactagagaggcaagagcaaacaaattcaaaagctagcaaaagacaagaaataactaagatcagagcagagctaaagaaatagagacatgaaaaacccttcaaaaaatcaattactccaggagctgattttttgaaaagattaacaaaatagatggaccactagctagactaataaagaagaaaagagagaaaaatcaagtagacacaataaaaaaatgatagtctttaatctttgaggctgatgacctttggatggggtttctgtgtgcagcttctttttgttgatgttgatgttgttgctttctgattgttagtttttctcttctaacaggcccctcttctgcaggtctgctgcagtttgctggaggtctactccagaccctgtttgcctgggtatcaccagtggaggctgcagaacagcaaagattgctgcctgctccttcctctggaagcttcgtcccagaggggcaccagcctgatgccagccggagctctcctgtatgtggtgtctgtcagcctctactgggaggtgtctcccagtcagaatacacaggggtcagggacccacttgaggaggcagtctgttctttagtagagcttgagcactgtgctgggagaatcctccttgtcaggatctgctgctctcatcagagccagcaggcaggaacgtttaagtccactgaagctgtgcccctgacagccgccccttcccccaggtgctctgtaccagggagatgggagctttatctatagccccctggctggggctgctgcctttctttcagagatgccctgcccagtgaggaggaatctagagaagcagtctggccacagctgctttgccatactgtggtgagttctgcccagtccaaacttcctggcctccttagcactgtcaggggaaaactgcctactcaaacctcagtaatggtggatgccccaccctctaccaagctcaatcatcccaggtcaacttcagactgctgtgctggcagcaagaatttcaagccagtggttcttagcttgctggggtccgtgggggtgggagctgctgagcaagacctcttggcttcctagcttcaggcccctttctggaggagtgaacggttctgtctctctggggttccaggcaccactggggtatggaaaacaacaacaacaaaaaaactcctgcagctagctctgtgtctgccctaacaaccatccagttttgtgcttgaaacccagggccctggtagtgtaggcacatgagggaatctcctgttctgtggattgcaaagaccgtgggaaaagcatagtacctgggctggatagcacagtccctcacagcttcccttggctggggagggaggtccccggctgcttgcacttcctgggggaggtgatgccccaccctgattctgctcaccctctgtgggctgcacccactgcctaaacagtctcaatgagatgaagtgggtacctcagctattcctattcagccatcttgccaaatctctctattatcttttataggaaaaaactttctgaagatgacatcagactcaagaagccaagtaggaaaagactgataaatctgaagatgtaaaaattaagatcctttactcagaaaaagaaaagtacaataaaaaaataaaaaataatttgagcaaaatatttgtgatacatgatgaacaatggttaagtgttcctagtaaacaaagaagtcatcaatctgaaacaatcaacagcagtaaaaaataggataagcatctcacggaaaaaagaaatactaagagcaaataaacacatgaaaacatgcacaacctcattctgaggaaatgaaaaacagaactaatggctgactacaagatttaaaaactggtgatacacaatgttgatgaggatgtgtaaaacagtcactcccatggatcattcattggaaaatatatcagagtaatcctgttggaggacaattttgcaatatctacacttagtaatttattgttctcaccaaagtacatggaggtgtattatggcttgagtatatggaggctgtagagccctcggagtatggagcccgatgccagggatcagataatagctcagcaacttctgaggtatgtgactgtggcaagctaagagccttacctgggaagtggagataagtatgtttttacctcaaaatgctggtgtgaggatctgatatatttatacactttagagaaatgcttggcactttggaacattaatctaaagaaaacatccaactgctcacgagtagagtgctaagaaggaagagcttggcctcatagttggatggctgccacgttccctgaaagtgaatgaagcaaacctctctctgactgggaggctgatgtctttacttcattaagtcctggggcatctcatgttccaggatagcatcactttccacgtttcttcctttttcatgcataagaattttagctagcggagagtaaggcaagtgaccatttcaaagacaggcattttactaaatggtggccactgaaagcttgattcctgtgctgttttctggtactttttgtcttaaagcaggatttctcaacactggcactattgacattttgggctggataattctttgttgagggggctgtgctgtccattgtaggatgtttagcagcattcctgatcttgatccactaaatgccccaagttctgacaaccaaaagtgttttcagatattgtcaaatgtcccttgggagtgaaatcacccttggttgaggatcactgggttttagaggtttggaatgaaaaaaaaaaatgattctcccgttggaagcagagactgtagttcagattatgaaccagttagatgatttcccttcttaagcatgaattcagactgcattgcctttgaaaattaatgtttggggtgtgtgtgtgtgtgtgtgtgtgtgtgtgtgtgtgtgtgtaaatattacggttaacagttatccactgggccctaggatgaataaggaagcatagcttcaccttattctcgacaaagtccttaagagggtccagattatgttccatcacactttcatgcttctgaattccacttaaaaaaaatagacttattggccaggtgcggtggctcacacctataatcccagcactttgggaggccaaggtgggcagatcacaaggtcaggagttcgagaccagcctggctaatatggtgaaaccccatctctactacaaatacaaaaattagctagtcggggcggtaatcccagctactcgggaggctgacgcaggagaatagcttgaacccaggaggcggaggttgcagtgagccgagattgcatcactgcactccagcctgggtgacagagcaagactccatctcaaaaaaaaaaattgacttattaattattttgaattagcaatatattcccatggttcaaaattgaagcaatataaatgagtgtagagtgaaaagtttctctctcatccctgtctccagatatctgggtcctgcccatgagaaagccacatgaacaggttctttgtttatccttccaaatatattttttgcatacacaaatatgtatatttgtatttataacatatttgtatatttcccttgtatatttgtatatttccctatctcatcccccccttttttaacaaaaacaggtcatacactgaacatacatgtgttcacccagactcttctatgtgcatatgttatctcttcaccactgcttcctttctaagagaactccgattttgtgcagttcttcagcaccataccctttcccctacctacccacaaacacacttcatggaatccatgtgactcaggggaagtggattccacccccagatctgggagtagctggtcaaagggtgacccattctctttgccagaggtcagttcagaaaggggcatgaaacccaactcaggccaatggacatgctgagaattttgctgggctttccagggaatttttttttttctcctgagagagctgtggaagaagtctcttttgcctcctctggacaccactatggggagaagtaaagatggggcagacacttgagggatggcccggaagaaactggagcgcctggattaagccaatcctgaagtctgcacgactgctgtcctttcaggcagaggaaagatgggtgatgtcactattagcagtctagggtgaggtgacaagtcagtgaagccatttcaaatccaagtctggtgtggcttgaaggcttttggtttacaacggtaaaatcagttctccgatgtgtagcattttacagtacaaacggtgctcccacattcaggtttcattgagagtaaatacgccaggcaaggcctctgtgcccactgcacagatgaggaaaaggagacatggaggggaaagtcttgtttaaggacacatatcctgtaagaggcagaactggaatccaaccccaagtttgtttctgttaccgaaacaccgggagtttggtctgggtcctgcggctcacagaacagaaagccaatgactgagacgatgagtattgccaaggacgaaggctttagtcgggttctgcagcagaggagatgggaactcagtctcaaatgcatctccctgactaactaaaactaggggtttatatggcagggaagcaatgtaaccgtgtgtaagaaaacgggaactagggaggggcaaggaagcaatcatggtgaatgaggggtcccacatcttattgtctgatgtgacggtctggtgaatttcagttctttggtactttttttgagatctgaagctcctttcctgaggaaggaactcggataaaacaaatataagtttcaagctttaagactagaagggtgaatttctatgtttatcaaaagaaaaaaaaactgtctatgggacaattgcattggttttatttaaacatcaaggttattttctcccaaaccaccagatactctggctggaggcattcatacccacagatgcatgccaagtgttgactctaccctcaggagcagcaggaccaggaagctctgggaggtcaggacacaggagagaggcaggaagagcccccgcaggacctactgtggtggccgagactgctacagccatatgacctccgactgtgcccagttccttttagcatgtcctcaagagtcagtgcctcggagcaaatgggctgacctctggactacactggggaagagagaaaaggaggtcctccctgttgcccaatggaagattcctcaagatggagattgagctgctcttctagggcaccccaagggcaaatgtccccatcgtctctaaggctccagccagctccaaacactctgggtggtaaatagactgaatcccctttagtgacctctctcactggcaatgttttttttctcttttttcttacaatagttgaattgatcaaaaaagaactcaatctcaaaggtgagagtagagttgatgatggggtcagggagctgacctcaatcgaaagttgagaagaaaagcatgtgtgaataacaacatccttggtttagaatttacttacaaagcttcagctgagcttatgaatgtgtcatttggatatttgctgggcttcgcacacaccccttcagtttctacacagggccaggcatatcacaatggtgtggttgcattttgtttttaatgttaggttcattttttatagatcctaaaacacaaaacgggattcgggagtgtgaatttacttgaaccaaactgaaaaaaggttttctcaacctctgcaaaatgaagctgcagaattcacaacagttttaattataacacactaaatagatacaataagtggctctttgctctgacgttgaaatctctacctatttttatctccaggcaaataacaggcggctggggaaagttactacattatgagtgggttattgaatctctgagcatcaacaacctctatgtcattacactgcattgtatgctaaagaaaatcattgtatccaggctgggcacagtggctcatgcctataatcgcaatattttgggagactgaggtgagcagatcacctgaggtcaggagttcaagaccagcctggccaacatggtgaaaccctgtctttactgaaaaaaaaaaaaaaaatacaaaaattagccaggcatggtggcgcacacctgtaatcccagctactccagaggctgagacaggagaatcgcttgaagccgggaggtggaggtggtagtgagctaagatcgtgccattgcagtccagcctgggcaacaagaatgaaactccatctaaaaaagaaagaaagaaaaaaaaaaaaaagcaaaacaaagaaaatcattgtattcaaaaataccaagatgagcaaaaatatttcaagatttcttagaagaaatttgcttcccataggcaaaggaaaactaagcacattaaaactactgctctaaagtaactttaaagcataattctccccttgagtttcaggaaagacctggaaagaggggcaagactttccctttctcaccttgccatgacctccagggccttgtagctcaggctttgaaaatgaaggtcaccataattactattacaacccagatctggaggaaggtggagaaccttgaacagagcccaccagaagtggctggctggggtcccagtgggctgcagggccagggaaggccctgcggttgctgccccacctgcctgctcttggcctcacttctttgcttctcctctggaagattctatcagaattgctttgtgctcaggaatgggcctatgatgaagagtctggctcactttttcctctgtactttgggattacatcatggaacccaatatcctgagcaagcataagaaagggaggggaaagtggatgaatctgatgtaagaagaaaacagacactcatattttcactcaattttcaaagcaatccacactacagatgaggaaactgagatttatggacgtgaagagacttgctgaaaaccacagtttggtggctgaagctggtttgaattttattctaacacaaatctttatttattttagacagggtctcactctattccttaggctggagtgcaatggcgtgatcatggctcattaaaacctcttcctccagggctcaagccatcttcccacctcagcctcctaagtagttggaaccacaggcatgcaccaccacccctggctaatttttgtatttcttgtacagatgaagttttaccatattgcccaggctggttgtgaactcctgagctcaagtgatccacctgccttggcctcccaaagtgctgggatgacaggtgtgagccactgcacctggcctcaaatatttttactgtattttattttttatttttgttggtacatagtaggtgtatatatatatggggtacatgagatattctgatacaggcatgcaatccataataatcacatcagggaacatgacatagccattatgtcaagcatttatcattgctttgtggtacaaaaattccaataatactactttagatatttttatatgtacaataaatgattgttaactatagtcaccctgttgtgctatcaaatatgcgatcttattaattctatctaaccatatttttgtagctattaaccatcttccctctcctccttcccagcctctggtaaccatcattctactatctccatgaatttaattgttttaatttttagctcccacaaatgagtgagagcaggtcaagtttgtctttctgtgcctggcttgtttcatttaacataatgacctccagtttcatccacagtgttgcaaatgacagaatctcactcttttttatggctgaatagagtactccactgtgtatgtgtacgacattttctttatccatttgtctgttgatggacacttaggttgcttccaaatcttggctattgtgaataacacttcaataaatgagaatgcagatatatcttcaatatactgatttcctttctttggggtatatactggcagtgggattgctggatcatatggtagttctgtttttagtcttttttgaggaacctccatacttttccccatagtggctgtattaatttacattcccaccaactaactcaaatctgtaaattataccatgaggatgtctaaatcaagggggcgatttttgcagtttctacaagaaaatcattgagtagttcacctaacttgattggcaaattcagtcaaatgactgtacaagttttatataaatgtagtctcatgttaaacatttaaatcatgtgttaccataaacaattattaaatcacttgaagatgtttgagaactaaataggatatttcttcatgatatatgctttaaaaagttttaattgcggtaaaatacacatgacaaaactttaccattttaacaattttaagtgtacagttctctagtgttaagtatatccacattaatgggtaaccagtctctaggacttatctcataaaactgaaactatacctattaaacaacaacccctcattttcccttctccccagcttctggcaaacacaattccaccttctgtttctatagctgactactctagagaggtcatatgaatgggatcattcggtatttgtccttttggattggcgtatttcacttagcataatgtccttaaggttcatccacgttgtagcacgtgtcagaattgtcctcctttttaaggctgaataatattccgttgtatgcatagaccacattttgcttagccattcttctgtcgatagacaggtgagttgttgccatcttttggcgattgtgaacattgctgctatgaacatgattgtacaaatatctctttgcaatcttttcaattatttggttatatacccagaagtggagttgctgtatcatatggtaattctgtatttaattttttaagaagctgccatagcgttgttcaaaactgctgcaccattttacattgccaacaacagggcacaaaaaattgaatttctctgcattctctacaacacttgctattttctgggttttttttgcaagcagttattctaatgggtatgaggtggtatctcacggtggttttaatttgcatttctttattgatcagtgatgttgagcatctttgactatgcttgttgtacacttacatacattatttggatagctgtctgttcaagtccattgcccatttctaagctgggttatctttttgttgttgttgagttgtaggaggtcattatatattccggatactaaccctttgtcagatgtatgatttgcaaatattatctcccattccataggttgccttttcattctgttgactgtttcattctgttgacttttgtcttttgacagacaaaagtttttaattttgatataatttatctatttttacttttgttgcctgtgcttttggtgtcatagccaagaaatcattgccaaactcagtatcaagaagattttcctctatgttttcttctcaggcttatatagttttggctcttacatttgggtctttgatcgattttgtgttaatttttgtatatagtataaggaaagcatccaattcattattttttgcatgtggctatccagttttcctagcatcatttgtggaaaagactgttctccccctttgaatgatcttggcactcttgttgaaaatcatttaaccatatatgggagggagggtttatttctgggctctctattcaattccactgattcatatgtgtgtctttatgccataaaggtactatggctttgtaataaatttggaaatcaagaaatatgagacctccaactttgttattctttttcaagactgttttggctattcaagatcctttgaaataccatacgaattttaggatgaattttttttttaatttctgtgaaacatccatgagattttgacaaggattgcacaaaatgtgtagattgctctggttagtatggacttcttaactatattcagtctttaaatataagaacatgtactgtatttccatttatttgtatcttctttaatttctttcagaaacactttgtagttttcagtgtacaagtcttttgcctcttggttaattctgagtattttattctttttgattctattagaaatggaattgttttcttagtttcctcttctgactgttcattttagtgtatgataatgcaactgatttttatatgttgattttatattctgtatattctgcatctttgctgaatttgtttattagttctaatagtttgtggaatctttaggggtttctacatataagatcatgtctgtgaacagacataattttacttcttcctttctggtttggatgcctttatgattttttttttttttttttttgagacagggtcccactctgtcacctggctagagtgcaacggctcaaacacggcccacttcagctttgaacttctgggcttaagtcgtcctcccacctcagcctcccaagtagctgggactacaggcacttgccaccatgtccagttaatttttttaaaaattttttatagagatgggggtcttgctatgttgcccaggctggtcttgaactcctgggctcaagcaatctccctgccttggcctcctaaagtgttgggattacaggctgagccaccgtacctggcctatgatgcatttttattgaaagaaaaacagacaccattattttgcattacaaaatataaaacagaagaaatttcacagccaatcaaacgggagtttagaattggatcctcctgcactttcccctacacttctttcaaagctgccttcctctgcaaggcttctgcctcacctctgatcacccacaacctgagctctgagcacccacacctcacctctgagcactatgacccatctggatggagctactgcacggtcagtgtgggaacatctctgaggaagatgcattgtcttctgtggagttacctaaaaacactggggcatgttctcctaactgccttcacttagtctaaagatgaagcaattcaacaaaagtacatgtaaacctcaaaactggacttggagttttaaagatcaatggactctattgtctattgtctggatggtttgggggtttcctagctcatttttttttcttttatggtatagacacctgaaggctctttgctcagtactcctcactgtgtggctgccttccactgcagacgctgtgctgaaggttgggttctggccactctgtttacacccttttggacttgaggcttgcctgttggttccctgaaacgtggactctggatctgggtgctaaccaattccctttctttccaggccggggtcctgagacctcactgtaatgagagactgtgacctcttttctcatgtctcaggcaggctatgatgccttttctagttaaggaccgtgttgaaccaggtgaaatcgccatttttgttggctgtttttgtcctgcaaaactgacaatttcatgtccttaaatttaatacctttggagtagaaactacctattgttgtccaatagaggaaacaaagtttcttcctgaaagcatttgtctgaacaaaacagtatttgttttatctgcatttccccttcattcacttgtatcattcagggacttgcacatctcagtcacatgtgtgacgcactcacatgtatggctccaatcccatcttcacggcacagagaactaaattctctcccaccttcccgtggagagccctctgtcctcatcatcactggttcctttcttctggatccttccacctcaattatgtttctctgagggtgcaatgacaagaataaaatgaaattttgttcttgttcagttaagtaataaattgtcatttcttccattttctctttgactaaagatgtattagctttattattattttttaaatagagacaatgtctcaatatgttgcccaggctggccttgaactcctgagcttcagtgatcctctcgcctcggcctcccaaagtgctaggtttacaggtgtgagccaccacgcccggtaaaagatgtattagctttaaacaaagttaaaatttcttctcagttgtgtaaaaatcacagaagaatgcagcatgtcctctaagtgtcagcctgtgtggggctgaaaaaacagtggagtcctttgttcactgtcttaggagtctttgggatttctgttgatccacagacttgcataaagagtttgtcatgatgacagggcctctgcacatgatgtgaggatgtggaccccctttcctccccacagccagtgccggcccgactcataaaagctcaaagatccagtgagaccagcctcagtcagatcagcccatccatgagtgggggttgttgttatatatatttatgctccatctcactgccaaagagggatttggggtggattatagaaatgcatacaacaggggccgggcgcggtggctcatgcctgtaatcccagcactttgggagagccaggtgggtggatcacaaggttaggagatcaacaccatcctggctaacatggtgaaaccccatctctactaaaaatacaaaaactagctgggtgtggtggcgcgtgcctgtaatcccagctactgggaaggctgaggcaggagaattgcttgaacctgggaggtggaagttgcagtgagccgagatcacgccacagcactccagcctagtgacagagcaagactctgtctcaaaaaaaataaataaataaatagataaaaataaagaaagaaatacatacgacaaaataaaaataaaataagcaaagaagtggaggaagaagaggagaattaaggtaagaaattaagatgaagtcatttgtttctttttgcctattcatattttgagttttctcttttcttattgatttgtaggagttacttgtatattctagatctgtgctaatacgttagccaccagtcctatgtggctattgaaattaattaggctgggagtggtggctcacacctgtaatcccagcactttgggaggccaaggtaggtggatcacttgagctcaggagttcacgaccagcgtgggagacatggcaagaccccatctctactaaaaatacaaaaattagccaggtgtggtggcacacctgtaattccagctacttaggaggctgaggtgggagaatcacctgagcccaggaggtaaaggctgcagtgagctgtaatcacaccactgcactccagcctgtgtgacagagaccctatctaaaacaataataataattattattaaagttaaatagaattaaaaatttagctcctcagtcaccctcctcccatttcaagtgctcagtaaccacaactatccagtggccagcatagacctacaccatttccatcatcacagccaattctcttggatagtgttggtctgtatattaatcccttgtcaattttattcatttcaaatatcttcttcgagaaaattgttctctgctaactttgattaagatgtcttcactgaacagaaatgtttaggcttttttgagacagggtcttgctctgttgcccaggctgtagtgcagtggtacaaccatagcttactgtaaccttgaattcctgggctcaagcaatcctcttgcttcagcctcccaagtagctagaagtataggcatgcaccacaatgcctggtcaatttaaaaattttgtagagatggtgtttcactgtgttgccagtcttcctacctcagctcacgagttctcacgagatctgatggtttaaaagtgtgtggcacttccccctttgctgtctctcctgctccaccatggtaacacgtgcctgcttccccttcgttttccaccatgattgtaaatttcctgaggcctctgaaccatgcttcctgtacagcctgtaggactatgagtcaattaaatctcttttcttcataaattacctagcctcagttagttctttatagcagtgtgacaatggactaatacaccttaaatgtttagtttttatatggttgtgttcatcatattttgccctgtaatatgtgcatttggagtcttgtttaagaaatctcctccctgaggtctcagagatatttcccctcaccttttggtatctgggttgtggatttccttttcatatgtgggtagtgaatccaataggactttgcctttgctacacagcgtgaggcagggatccaaccctatgctctccatctagtgaggggttttccccatcattgctgttaacagattcatctacacatccatcgtctccccacaggtcttgtgtgccactgctttcctgtgcccatccaaggtccatgagggcaattttgggctcttgcaggctgcatccatctctttatgtttcctctgccaggaccaaattgtcttatcactctgactttgtgcaacgacttcacgcagggagagtgctctattctccctcactcttgtgttgccaaatgttcatagctcttctaggaccttgctcatctagattcactttaaaatctatctttttgagtttctcaaaatgtgtatagaaaatcagcagtcactcactaatgaaatactctcttttaagtgaaaaataatatatgtgctgtgaagctccgtgatctactttaaacctaggaatgaagttccaagtgttaacggtgatttaaaatccattccattgagtttcggtttgtctggggcatcagtaaatgctcatttccaaaagtgctttgcctttgaaggctactaatgcatgcagtgtgttgccatggcaacggttacttttagttagtactttttatagattaaagtgctacaccctggagtctattcatataaatgcataaatcttaagacagtatggtacttcatttaatgtagatatttaatggaacagagtcagacttaactgaccagaaatggaaaattttcaacacttatatttgatacggacatgcagtgttaccaaaaatataacattttcattactttgttttacaaaatataaattaaccttgctatccatttaacttggtcaatatttaataaattgtggttgaaatgtatgtgtctgtcagaaatttgcacatatcactttgttttctaccctagagtaaaatccccaattattgtagggattcagaagacttggggaacaaggtgtttcccaggcaaatggaggggaagtcagtggagccctgggtgggaaagagtatatgggcctgggcttggattttggcagtgatttttattagctgtgtggccttgaacttcagtttccccagtcataaaatggagatcatcacatctactttgcacagcagttgtgaagattaattgtatcttcagtgagtgatatctatgatttaaaaatgactagataatgatttcaagtcaatatttaagacagaaagagagggtggaaatatcaagtacaaaagtgctgcggaaagtcaatagtcaacgatcctggtggatgggaggtctcagagacaggggaattgggcaccgcttccacgcacacgagaggagaaggacacagaggcagagatcagcagagcagtgggcatggaagagggaccatggggttggctgggtgaggcttggtcaggaaagacaaaggggtggcggtaggagcccccaagggtgggttgagagctctgtgccttacacaaagagtgaccctgaactgtgccttatacagaggtgacaagaagtgttttagaagggagatctggtaaacaaaggggcacatggagacaagcatgagggctggatgtgcccctggcctgaggacagcaaggcctgaacccaggaggggtgtggagagtgagatgaagatgagaatctcacagtcacaaagaagacgatatagggattagctctactggaaacaggagtggaaagagccaaaatggtctccgaagctttgatctcttccgatgaacaattgtttaaagcaacaataatgacaataacaaaacagtcatcccttggcatctggggggtattggttccaggactcagtttcttgccacgtgaatctctccagtttgctttgtcagagcaagcacgtgaaaagaatctgaacaagatggaagtcactgtcttttataatctgatttccaaagtggcatccatcacccttgctgtgtttattcattaaaaccaagtcacgagtccagcccatatacacaaggagaaggaactacacatgggcatgaagacaaggagacaggggtcgctgggagccatgctggaagctgcctaccatactaggggactggagaagtggaaatactcttgaccaaaataggacaggaggatggaaataatttaggacccagatgatgaattcagttgtaatcatggtgtatgagctaatggcatggcatcagaaccagaatccacagccatttgagccatgggagagctctagaaagaaggcaagccacggacatggattaggaagcatcctgttttgaccatgttcaggacatgtattcttagcttcattgcacatgtctgcaaaacaaatgagtctgctacagggctgtcagacagggctgtggtttcatctgaaggttcaacaagaaaaggatttacttccaacctcactcacatggttgttggcaggattcagttctttgcaagatgttaggatgaggttcttgattctttacgaacagtggcctcgtgagaagtcttgagttggataatccaactcaactgtggctggatacctgacccacagaaactatgaaataataaacgtgcttttcaagccactaagttttggtgtgatttgttatgccgcaacagataattaatacacccagtttccaactctttgatcctatcagttaccataaggcacctagaagttttcccacccttccaagtcctcaaaatttatgcttttctggaatttgagagaaggtaatggtccacttagggaggaagctattgtttggtacatgcctccaggcaccctttctcctgctggacaactgcttctccagtctaatcctgctctagctttttgctgggaaataacactccactcactctttcaccttggacttcctgtgctcccaaacttggcttgggtccagactgtagtcttctgtgtccctgacctggatttctattccagaacctaaatgctgcatgtctaagctgatctggtcagcaaattttttatcgctcttgcatttgatagttggattgtggcattcctgaccttgcattgcacccgcacaaatcaaaacagccttggcagccctgtaagataatttgattccattccctagcaatacagggccaggtccaaagttaccaaatcagggccctgactgctcctggcacccagccctggcccatggcttcctgactgatcttcctgacctttgcctttccagctccaccacctcaaggaggcatgaacgatctttcagaggcatgtgccaagttctgagcttggtcttcccatccttccagggggtgtgggatgggacttggagttatgccagctcttcagaaggggatgtgcatgcaccagctccaagtagagttggcaataggcaccgctactcagtggcacagtggtgactcatgaaagcagtggggagtaggacatggtggcagagaatcagttcccaggccctgctcagcaattatgaaaaaggctgttaacttggcaccaggaaaatagagtaaaggtcgcttttcctgacttccaaggacttccacagactgaggccaacctgctcgcccaatgtgttctctactgtgagccctctgctctcactgtcactttctagtctggaagtcaaaaaattcttctccttcttcttctctttcttcttctcctccttctcctcctccttctccttctccttcttctttctcttcttcctcttcctctcctttccttctcattctcattcttcttttttttttttttgagacagggtctgactccatcacccagggtggagtgcagtggtgtggtgtcagctcactgcaacctctacctcccaggttcaagcaattcttgtgcctcagcctcccaagtagctggaattatagccgtttgccaccatgcctggctaattttttatttttagtagagatggggtttcaccatgttggccaggctggtctcaaactcctggcctcaagtgatccacccacctcagcctcccaagtggcctgctaggattacaggccactgtgcccagccaaaaatatttattattaataaatggatgagccttgtagaaattatgtggaacaaaagaatctggacacagaagagtaaagactgtatgctccacttagatgactttttagaataggcaaaattcatctaaagtggataaaataaaggtcatacttgttgccctggttagttacctggaaagggacatgagggagctttctggagtgatggaaatgctctatatcgtgataggggtgtgagttacagaggtgtgtgtttgttaaaataaggccgggtgcggtggctcacacctataatcccagcactttgggaggccaaggtgggtggattacttgaggtcaggagtttgagaccagcctggccaatatggtgaaactccatctctactaaaaatacaaaaattagccgggcttggtggtgcatgactgtaatcctagccacttgggaggctgaggcaggagagtcgcttgaacctgggaagtggagtttgcagtgagctgagatggtgccactgcactctagcctgggtgtcgcagggagactccatctcaaaaataaataaattaataaaaaatcggctgggcacggtggctcatgcctgtaatcccagcactttgggaggccaaggtgggtgaatcacgaggtcaggagatggagaccatcctggctaacatggtgaaaccccgtctctactaaaaatacaaaaaaaattagctgggtgaggtggcgcgtgcctgtagtcccagctactcgggaggctgaggcaggaaaatggcgtgaacccgggaggctgagcttgcagtgagcccagtatatatatatatatatatatatatatatatatatatatatatacacttaatttttgttactttgtcattatggcattttgatatatgtcaattttaccttcaataaaactgtaaaaatattaatggttgagtaagggcaggggagtggggtgagctacagaagaccctggaatggcagaatgctgaatgtcgaagctgggtatttgccgcataggggtttattacgctattctgtttactttgtacatgtttgaaaatttccacaataaagagtcaaaaaaaattttatggtgcacatattctgcaccatgtcctatgctaaagggcatgcacaggcagacaaggctgcagaatacagaaagaacaaaactgaagatggaatttatttttttacatttatttttagagatggggtcttgctatgttgctcaagctggtcttgaactcttgggctcaagcgaccctcccacctcagccacccaagttactgggattacagcattattcaacctgaagattggaagattttttttttttttttttttttttgagatggagtcttgctctgtcgcccaggctggaatgcagtggcacaatctcggctcactacaagctccgccttctgggttcatgccattctcctgcctcagcctcctgagtagctgggactataggcgcccgccaccgcgcccagctagttttttgtatttttagtagtgacgtggttttcaccgtgttagccaggatggtctcgatttcctgacctcatgatccgcctgcctcggcctcccaaagtgctgagatttcatgcgtgagccaccgcgcccagccaagatggattttttacttacaaacataaagtgcattgaaaagggggaaaggtggactaaacggaaagtcatgccagccccaacatgtggctccaagaagagaaccctgcaccagaagggaagtcatccaactgcttctttcatggctcacaacatgtcacgagaccatcgccagcagaactaaacactgggcgaagcgatgtggttgatttacattctggctcaggctctattcttgaaccatcagccagaaatgtgaccaacactaaggcaatgatttattagattcacctgggagcacccagataaactaaatcagaatcccttgtggcagggctcggcatcagtgtattttgatgttccagatgcaattccaatacacagccagggcaagaaccagcgatctgtgagctgctcaagtcacattgcttccaggaagtctctcttcatgctcgctcacaaagagccttcttttatccaacaccctaaacattgctgactgacagtctgctatctaggtatatggggccttgtactgttttgaacaattcatgcttgtcttctttaatgaggatgtctgcacatgtgttcttgagggtaagaattaccttttacatttttgcattccccacaacactttgcactatgatgttcaataaacattcaattttcaaatttttatttagacaatgaaatatttccttattataaattggctgcattctttaattctcagagtactgaactaaatgattaatcattactggaacatgttctttcataatgaaaatactaaaagatttataaacttaaacataacttttcagttatttaatttggggattttccaagtcaacgtatttcctattgaacagatttttgtctatattatttttgctctctgacctgatgtgaatctttcagacgctgggttggttgaaggggaaacagtttttctaatgcagctactgtgagctgagctgacttaggccttggagaattaccattcttaccaattgaccacaaaagcagataggaacagtatctacgtattacaaaccagaatcaaaatgaccttcacacatgattagtgtggaattcttttcagtggaaaatggcaacatttagcagcacagggtgcagttggcttcaaatactctctgaagtgaaaccattgtgttttcctgggtgactgagcccagggctaatgcccatcggagaagctgctgggaactgcaatgctttgattaaacagagtattaaccacaggctggctgtttgaaccatatcgataaagacaaaattcaccctatctaccaaaacattctttcatgtaagacttaacaatgaaaataaacaaaagctttagctgtcaactatatataccatgaagaatggcaaaactggtttttgttaatgctattttgtcttttaatcgctcagttggctatgaaaactcttgtttacattcctttacatattgttgagcttcaaggtaattgtgaaagaaaacggggaattaatatcacttcccagaagccacattttatttaacctcaaaaactttatgtaaaagattttgttatgaatcaaaggctggcagttcttcccactggggtgatttaggaaattaaagttaggagtagatggtgctaatgggaatggtaagactagtaagagtgatttattccttgcagaaaaaaatcactgtcgatgctcagttgaaataatgtggaatttaataattacctcatagtaccatctagtggtgctatatttctacccttgtgttaagtgaggactgtagttttctgtagcccgaagccagcaaagccaggtcagtggtctattacaaacactttaactgtaagctgttagaagggtgagttcacagagaaaatgtaaacaaagtattagtagctcatatgacaatattaaattttaaaatgttcccagaactcagacatgttcaatatggattctcaataaattgtgtttttaaatattgaacaaatactgtgattacttttttcacaataattacagcaatttgggtagttttgggtactaccgtaagattctaagcactattttatatttttcctattctgaacaattgtggtttgtgcatttcttccagtaaatgcggtctggaaaataaatacctttcacatggtacgtgttattggaaaacaattgtctttagtgagatttatggaatgtggagaaaaaaaattttttaaggaactattgctcctatgaaagcttgagagtgttacgggcaatgtaggcacttttagatcaaattcaaacataaaaaggcacttacacacattttaagaatacttgtaattataagcacattttcagatttacaggactaagtctagtttaagcataaaccagattcaatgtgaatctctatatatttttcttgcttcaagtattattttacagaagggacactgatttgtttggcctgtgtaaacctaagaatctaggtttgatctagtagatatcatatctagtagatgtcatatctcaacaataaagggtctgaagaataaatattaatatttaggcctaagttattttttaaaattcataatgtgtctgtcctgttttgcttactgaattaacaaatctttaaagaaaaccttcatatattatagcgatatatttataccacagtgatatgatttattgaatgtgagagaaattctcacactcaattttaattttcttaaaaagaaaagatgggaaaatgttacagtatttaaatagtgaatgctgggcggcgacggcgacatggagagcggggcctacggcgtggccgaggcgggcggctccttcgacctgcggcccttcctgacgcagccgcaggtggtggcgcgcgccctgtgcttggtgagcccggggagggcgggccgggggcaccccgaggaccccccccgccgccaggcccggcgggacccctaacccacgagcgtgacaggtggaggcggccgcgtccgggccctggcggcgagcggggcgggcatttagcgtcccgggccccgccttcccgccctccacagtcttcgccttgatcgtgttctcctgcatctatggcgagggctacagcaacacccataagtctaagcagatgtactgcgtgttcaaccacaacgaggatgcctgccgctatggcagtgccatcggggtgctggccttcctggcctcggccttcttggtggtcgacgcgtatttcccccagatcagcaacgccactgaccgcaagtacctcgtcattggtgacctgctcttttcagctctctggaccttcctgtggtttgttggtttctgcttcctcaccaaccagtgggcggtcaccgacccggaggacgtgctggtgggggccgactctgcgagggcagccatcaccttcagcttcttttccatcttctcctggggtgtgctggcctccctgacctaccagcgctacaaggctggcgtggacgacttcatccagaactacgtcgaccccagtccggaccccaacactgcctacgcctcctacccaggtgcatctgtggacaactaccaacagccacccttcacccagaatgcggagaccaccgagggctaccagccgccccctgtgtactgagtggcggttagggtgggaagggggacagagagggccctcccctctgccctggactttcccatgagcctcctggaactgccaaaccccctctttcacctgttccatcctgtgcagctgacacacagctaaggagccttacagcccggcgggggctggccgagccacaccccacgtgcctgtgcccagagggcttcagtcagccgctcactcctccagggcacttttaggaaagggtttttagctagtgtttttccttgcttttaatgaccccatccccgcctggagtggctagaagccagcaggcacccatgtgctactgacaagtgcctcagcttccccccggcccgggtccggccgtgggagccgctgttacctgcgttctctgccaaagactcgtgggggccgtcacacctaccctgtgcagcggagccggaccaggctcttgtgtcctcactcaggtttgcttcccctgtgtccactgctgtatgatctgggggccaccaccctgtgccggtggcctctgggctgcctcccacggtgtgaaggcggggctggtgctcatggcacttccttcttgctcccacccctggcagcagggaatggctttgcctgacaacacccagctttatgtaaatattctgcagttgttacttaggaagcctggggagggcagaggtgtcccatggctcccaaactctgtctgtgccgagtgtattataaagtcgtaggggagatgcccggccctgggatgctgtttggagatggaataaatgttttctcattcaaaaaaaaaaaaaaattagtgaatgcttttgtaaaatagcagccaaaccaagaccaaaatgtttctttagtgtactttcatgcttaatgctgacagatagcattgtttgaactcacaatcaattttttatatataccttttcattacaaaacaaataatattcatggcagaaaatgaagaaaaccaaaaaacaaaaataagataagaaatttcacctgaaatcccaacacttaaaatgccatttaaaatattttcccaagtagccccattttttaaaatgagcaaattagcttcccacttaacttctttcacttaatactaaactgtgaataactttcacagtgtgattttcatttctgaaattgcccagcttctaaggcccactgcatgcaaggaatttagctaaaacacatagtccttgaggagatgacagtctagaagcagagacaatatacactgtagttaatgacagttaaaatgtccttaacaagattaaaaactcgtgggaaaagaatgaaatcctgtcattcacagcaacatggatgagcctggaggacataaggctaagtgaaataaaccaggcacagaaaggcagataccacatgatctctctcatgtagcgtcaaaaaggttgatcacatagaagtagagagcaaaacagtgattaccagagcctggggaggggaaacagggatgggaagaggttggtcaatgggcacaaagttacagttagacaggaagaataaatgctggtgttcccgtccatagtacgatgactacagctaataacaatgtagagtatatttcaagtgagctaataaagaggatcctgaaagttatcaccagaaataaatgtaaattttgtggtgaatgatatgctaactacccagatttggtcattatacaatgtatacatgtagtgaaacatcacactgtaccccataaatgtgtacaattattatatgtcaaatataaacactttttttttttgagacggagtcttgctctgttgcccaggctggagtgcagtggcgcaatctccgctcactgcaagctccgcctcctgggttcacgccattctcctgcctcagcctcctgagtagctgggactacaggcgcccaccaccacgcccagctaatttttttttgtattttcagtagacacggggtttcaccgtgttagccaggatggtctctatctcctgacctcgtgatctgcctgccttggcctcccaaagtgctgggattacagacatgagccacagtgcccgtcctaaacatgttttttaaaagaacacacaaaaaagaataaaattccctgagaactagctttatttcttccatttctgtggtctcctggtctcagactggaattgttttgttattaagtaaaaaccagccctcaactggccaaagcacaaaggtaagtcactgactcatgtaactaaactccctaggaacagacccagcttcagacagagctggatacaggctgctcatctgcctaatttggtctgggtgctgctccttggctcttggttagcttcctttctgttggttcctttctcctttgcagaggcaaaaacagcacacgcttttagttggagtcttgctgcctcctgggatgttcttcaccaccatcctggggattcactttgactcaatcttgggttgggttctttgtctccttatcccatatattcctcttctttgatttgctctcttattttggtggaggctccactctactagtttcctgagagaagctgccttggaatgaaatgttttgagactttgtatgaccaaaatgtttctttagtttacccttgtggttaatagttttgctggtgtgaaagagactgccagtgttacatatatcttgtcctcctttctttcctgggtacatgacgggattacctttgcaaaggactaacagtatctttgcagttaggtagtcttgtgatgagtgtagccaataaaatgaaaaaagaagtgtgtgacctccaggcccagggaattaatagcttgggtgctactccaggctctcttcccctgctgcaggagctttggaggccccttgtttcagagcaacatctcaaggtgaaaagaacctggatacctgaatcacaggatggaggggatcacctgccaacttgcctttgcatgaacaagaaggaagcgttgttaggctggcctactgagatgctagggtttctttctttccttcattttaaaattgcaacgttatctcagtggaatagattattcttaggtgcatcgttcatataaagaaaaattcatgtaatcccagcactttgggaggccgaggcaggcggatcacgaggtcaggagatcgagaccatctggctaacacagtgaaatcccatctctactaaaaatacaaaaaattagccgggcatggtggctggcgcctgtagtcccagctgctcaggaggctgaggcaggagaatggcgtgaacccgggaggcggagcttgcagcgagctgagattgtgccactgcactccagcctgggcgacagagcgagactctgtctcaaaaaaaaaaaaaaaaaaaaaaaaattcaaaacactcctgagggatacaaagaaaagtcaaagaggtggaaatctgtaatcttggaaaggaagattcaccaccaaaacagtaaccatagtggagagtgtgttaataataaagttgatgcaattccaataaatatcccaacaggattttcttttttgagggagagcgaaacaatctgattctaaagttaatgtggaaagaaaaactctaaggaaatataaagttaaattcggatctcacacctgactccaggataaattctagttgattaaaaaattaaatgtaaaaaaaagataccataaaatattagaataaacaatcatacttgttttgaatcaaatgctggggagggcatttctaggtacaacataaaactggggagccatcacagaagagtttgatagattcaattattctaaaatcaaaaagaaaaaatccacatgtaaaaaccctccccaggcaaagtcacaagacaaacagtaaactggcgagcatttgcaactcaaatcacatataaagaataatttcattgctgtatgttttagtccatttgtgctgccataacctgagatgggtaatttgcaataaatagaaatgtattaacccacagttctggaggctgggaattcctgagaggtcagtgtctgacaaggaccttcttgctgcatcatcccatggtggaaggcagagggcaagagagagggcaaggggctgaactcactcttttataataacatcaatcccacccatgagggcagagcccccatggcttaattacctcttaaaggtcccatctcttaataatgttacaatggcaatttaatttcaagggtatgtgccaccacacccagcaaattttttttggtattttttgcagagatggggttttgccatgtttcccaggctggtctcaaactcctgggctcaagcgatccacctgcctgggcctcccaaactgctagtattacagatgtgagccactgcacctggccttgtctcattttaatgtctctctggacctgataattaaaaagacttgcatttctcagataaaagtgattttctttttctcaaaaggatatgaacagagagaaaagaaaatgcatatggatcttcaaagatgaaatgatgttcagtctcactcataataagtaatttcacacaaactacaatgggatataatttttcacccactagaccaacaaatacttcaaaatttgataacacattgtattactgaggatacagggaaacaaggacaatcacaaattacttgtgggagtctaaattgtttgtaacccttacagggcacaatttgacaacatctaggaaaattttgcatgcaaataccctttgaaccagcaattctcttttaggaattcatttatatttatagatatgtgacatgatgtgtgcacaagtctcttcatggtgacactgtaacagcaaagacgagataagctaaacagtagtcaacaggggattgcttaaataaataacagtacagccacacaaagaaatattctgtagctctaaaaatgaataaagaagctctttatgaacagacatggattcatctccactgcatattgctcagtgaaaacagtgagttgtagagtatgtctacattatactactatttgtggttttcttaaatgaggaaaatatgtatagcttttgcatgaaaaaaatatctctagaatgaagtatgtacaaaaatctgttaatcatgactgttcatgggaaggggactggataggagagaaggtggaagggagaattttcaccattgatactttgaacccattgattttgggaccaagtgaatacactgcttatctaaaaattagaaatagttaaaatttaaaaagaaaatgtgcagtggctcacgcccgtaatcccagcactttgggaggccaaggcaggcagaacatctgaggtcaggagtttgagactagcctggccaacatggtgaaaccccgtctctactaaaaatgcaaaaattagccaggcatggtggtgggcgcctgtaatcccagctactcgggaggctgatgtaggagaattgcttgaaccccggaggtggagcttgcagtgagctgagatcgcgccactgcactccagcctgggcaacagagtaagtctccgtctcaaaaaaaaaaaaaaaaaaagaaaaaaagaaaaaaaatgtgaagagaacagtttgggcacttgaaacctacctttcagcatcattggtgatgtaacccttggggtggtcagtttataggccacacgtgtgagagtgccactctgctgtctagtctatcttagcaattttagggacactattgctgtgaggagtgacactgtccctgtccaccatatgagaagaatgtgggttttggtttccatttgctaagatgacattcagctgatatagtccagaggaaagaaaggaaaacagagcaactcccttttgatatcttagttgatgacagccataattagtgagtaagaaaaaatgaaaagatttccagtcgaagatgactgactaaacatgagaatttacccttcctccctgtttaaatcctatttcagggaccaaagggatataaaatggagagtaattctgtagcagcattggaaatttagaaaaggtgctttttgtgttttaaaaatagatttagggggtacaagtgaagttgtgttacatggatatattgcatagtggtgaagtcggggacttttattgcaactgtcacacaaatagtgtacatgacactcattaggtaatttctcatccctgagccccttctcaccctcccaccttttggagtctccaatgtctattgttttattctcaatgtccatgtgtacacattgtttagctccacttataagtgagaacatacactatttgactttctgtttctgagttatttcactgaagataatggcctccagttccatccatgttgctacaaaagacatggtttcattttttttaatggctgagcagtagtccatgatgtacatatatacaccacattttctttattcagtcatccattgatggacacttacgtttattccatgactttgctattgtgaataatgctgcaatgaacatacaagtgcaggtatctttttcatataatgatttcttttcctttgggcagatatccacgagtgagattcctatatcaaatggtagtactacttttatttctttgagaaatctccataccgttttccatagaaattgtactaatttatatttctaccaacagtctataagtgtttccttttctccacatccttgccaacatctgttgtttttttgacttttcatagccattctgactggtgtaagatttttgtttgtttttttgagatggagtcttgctctgttgcccgtgctggagtgcagtggtgtgatctcagctcactgcaagttctgcctcccgggttcactccattctcccacctcagcctcccgagtagctgggactacaggcgcccaccaccacgcccggctaatttctcttttctttttgtatttttagtagagacggggtttcaccgtgttagccaggatggtctcgatcttcttgtgatctgcctgcctcagcctcccaaagtcctgggattacaggtgtgagccaccgcgcccggccaagattttatctctttgtggttttagtttgcatttctctgatgattagtaatgttgaacattttttcatatgttcgttggtcacttgtatatatccttttgaaaaatgtttattcatgtcctttgcccactttttaatggggttatttttttcttgtacagttgtttgagttccttgtacattctgaatattagtcctttgttggatgcagagtctgcaaatattttctccctagacttcataaattacttcagtaaagtttcaggatacaaaatcaatggtacaaaaatcagtagcatttctatacacctataacaaccaagctgagaaccaaaccaagaactcaatcccatttacaatagctatgaaaaaaatacctaggaaaatatttaaccaaggaagtgaaagatctctacaaggagaactacaaaacactgatgaaagaaattgtagatgacacaaacaaatggaaaaatatcccatgctcctggattggaagaatcaatactgttaaaatgatcatactgcccaaagcaatctatggattcaatgcaattcctaccaaactactgtgttagtctgttctcaaattgctacagatacatgaaactgggtaatttttaaacaaaaaaggtttaattggctcacagttctgctggctgtacaggaggcatgactctggcatcttctcagtttctggggaggcctcaggacacttacaatcatagtggaaggcaaagggagagtgaggagtctcacatggtgggagcaggaacaagagagagaccggcaaggtgctacacccttttaaacaaccagatctcatgagcactcactcactatacagtaccaaaagggcatggtactaaaccattcatgagaaactgccctcatgatccaaccacctcccacgaggccccacctccaacactggggattacaatttcacatgagatttggtggggacacagatccaaataatatcaattaccaatgtcatttttcacaaaattaaaaaaaaatcctaaaattgatatggaaccaggaaagagtctgaatagccaaagcaatcttaagcaaaaagaacaaagctggaggcatcacattacctgactttaaactactctacaagtctatagtaaccaaaacagcatggtactagtaaaaaatagacacatagatcaatggaatggaatagggaacctagaaataaagccacatacctacaaccaacagatctttaacaacataaacaaaaatatacagtggggaaaggacaccctattcaataaatagtgttgagaaaattggccagtcatatgcagaagaatgaaactggaccaatatacaaaaattaactcaagataggattaaaaacttaaatgtaagacctgaaactataaaaatcctagaagaaaacctaagaaaaactcttctggacattggcctacacaaagaatttatgattaagacctcaaaagcaaatgcaacaaaaatgaacaaagaaaaacaggacttaaactaaaaggcttctgcacagcaaaagaaataatcagcagagtaaaacgacaacctacagaatgggaaaaatatttggaagggatgtttttaagagatcagaagagacaaaacattcttgaagatataaagtagatggaatcagattggtggcagttctagaatttgggtgcagaataaacctgctagcattgctccaaaataaaacaagaaattgtactaaaggtttaggtagtgctaaagagaaagagagggctgggcgcggtggctcacgcctgtaatcccagcactttggaaggccaaggtggacagatcaccagagatcaggagtttgagacaagcctgtccaatgtggtgaaaccccatctctactaaaaatacacacacacacacacacacacacacacacacacacacacaattagctgggtatggtggcacacacctgtaatcccagctactcgggaggcttaggcaggagaaggcggaggttgcagtgagctgagatcgcaccactgcactgcagtctgggtgacagagcgatactgtctcaaaaaaaaaaaagagagagagagagaaagagaggatgttggggctggagaatagaatcagtactctcaggtaacagatgcatggagtggggacaaggaggatacctactaagaagtcaagcaactcggagaatctaaatgtcagtctgtctagtcacaggtcaactcgttgctatgtcagaaaagcaatcagttctagaaaattaaaaacacattctaaaataaaaaatcgaatgactgtttcacaaagaatgggcctaaccgaagatcttatcagagagctgaaagactgaatagaggaattctcttagaatacagtgcaaaacaagatgacagggataaagccgaataagtcagcaattataattaatatgaccaatgtgtagtgctcatagagtacttgggttcaaatcctgcccaatcctttctgatcttgggtaggtcatggaatcactcaaatcctcagtttcttcagctgttaactggggacaaccagaagaactacctataggctaggtctgagcactgtataaaataacgcgggtaaagtgctcagtagaatacctgaattgagaggactcaatactgcttagctacgttcctatcactattaatattactaatgggccatcagacatgctaaaaataaatacctacaacagagtggagaccctgtcactaaaaacataaataaataagtaaataaaatatacaaccacactaacattcacaaaagtattctaaaataaaattattcaggaatgttgaaaattaaatgacaaaggtagtcacttatttacaaaatctgtgaaagatgagaaatgtgaaattaaaaaaatggaatttaaagccaaaaatattcaataggacagattttatatttacacataagaatacgaagacactagaagagcaatgaatctttatgcctgaacaacatgctatcagaatatataaagaaaaatgaattgataagttaacagtcaaaatgagaggatttagtaactttctcaggaaagaactgatttaatagacaaaaagcagttttagattttgagatcacaaggctgactctgtagtaatatacagaaatttgaactcagtatagaatatacactctttgtaagtacacgtatactatctacaaaaattgacatagtaataaaccaaaaagtctcaatgaatttcaaaaagcggaaaacatttaggctaattttctaactaccatgcaataaaaccagaaattagaaataacaaagaaaagaatatccccaatcaaaaaaaaaaaaagaaaaagaaagaaaaagttatatgtatttggagataaaaacaaagcaaaacagagaggctttctgttatttatgcgtaaaccaggaaatcatggttgcgattgccaacagtttatgctgggacaagggctcagtgtagtaaagccagcaggatgtggccaaaaaatgtaagaagacaagggaaaataaatgaactctaaatattaggagacaaagcatagaaagtagaaattttaaaataaaaaagcagaaattaatgaaacaaacaaacagggcaaacaacaaaatttgttaagccccaaatcgagttctttgaaaaatagctaatacaactgtgaaactactggcagacctgacccagaaaaaaaaaaggaagaattagaaaagaaatataactataaatagggaagagatttaaaacttgtaatcaactctatagaaataaattggaaaatgtgtaagaaatgaatatttttataaaaatgtaaactaccacaattaacgaaagagtcagaagacccaaatccttgctggttctgttgaagaaatggaaaaggtagtcagaggtccggccctgaaacaggcggcagatataggtagtgttatgggggatgctagtgaaccttcaaggagcatgtgattccagttattcaaactgtcagagcacaggaacagatggaaagttttccttctccttccaagtctagcaaaatcttgataacaaaactcatttgaacgataagtatatgaagtaatgcatatgttaattagcttgatttagccattccacagtgtctacatatatcaaaacatcatgttgtacaccacaaatatatacaatttttatttgtcaattaaaaaaataaagtcaaaacaaaacaaatttgcactcaaggggtacagaggtttgcatggaaatgcttcaaaaaggcctggaaataatccagatgctagcaggctacctcctagtggctggagaaagagggctgtcactttttaccctacacacttctgtacaattttatcttttttctttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgacatcacgcccggctaattttttgtatttttagtagagacagggtttcaccgtgttagccgggatggtctcgatctcctgacctcgtgatccgcccgcctcggcctcccaaagtgctgggattacaggctcttttttcaataagtatgtatgagtggattaacaatggaatgattgtttaatgcattcattattttattactttttaaaccataagaagaggtaggaagtattatctacataaggggttggcaaatttttttctgtagagagcaagatagtaaatattttagtctttgggggccatgcggtctgttgcaactactcaaccttggtggctagcatggaagaaaccacagactatatgtaaatgaatggatgtggctgtgttccgttaaaattttatttcaaaaacaggctgcaggttggatttggtccactgccatactttgctaaatctgatttctatatcagtggggaaattggtattttgatatattttattaagcctcagtccaatattttattcatttatttaaaaatatttactaaagacctttatgttccaggcactgctgtaggaactaggagtactgggaacataccagtgaataacacaaagccactatcgtcatggtggttgcattctattctgagaaaacagacaacaagcacatgcagaacaaaaacaacaaaacaaaacaaaacaaaaaacatgctcaagagtgatcaatgctataaagaaaacaaagcaggataagagatagagggcgctggagtgggggttggtacagttttagaggggatggtaagaaaagcctctgggccgggcgcggtggctcacgcctgtaatcccagcactctgggaggccgaggcgggcggatcacaaggtcaggagatgagaccattctggctaacacggcgaaaccccgtctttactaaaaatacaaaaaattagccgggcgtggtggcgcgagcctatagtcccagctactccggaggctgaggcaggaaaatcgcttgaacctggcatgcggaggttgcagtgagccgagatcgcaccactgcactccagcctgggcgacagagccagactccgtctcaaaaaaagaaaagaaaagaaaagtctctctgaacgatatgtgaccatcagggagtgtgaagtcctgagccagaaccaggagaaggctgatgtgtctacagggggctgagaggcgggtgatggggtgacggtggtgcagggaatccagggtctgggcagtgactcggaggaagacaacatggtgagcagttgtaagatcctgaacacagtttgaaggtggagctggcaggaatactggtggctgggatgtggagtgagggaaagagaagggcggagaatgattcaagtctttggacagaatggccatttgctaagacctgagcaagtaatgggtttggtggggcgctagttctgagttgttgttgttgttgttgttgttgttttgaagacggtgtctcactcttgttgcccaggctggagtgcgatggcgctatctctgctcactgcaacctccgccttcccggttcaagcgattctcctgcctcacccttccaaatagctggaattacaggcgcccaccaccacacccggctaattttttgtatttttttaggagagacggggtttcgccatgttggccaggctggtcttgaactcctgacctcaggtgatccaccctcctcggcctcccaaagtgctgggattacaggcgtgagccaccgcctggttttgcatgtgttgttggggctgcctgttagactgcaagtggcttctgtgaataagcagtgaattggagggtctggggttcagggaggggtcaggctggagaggcaaatatggtacttatagggtagaggcccatgagatcatcaggaaaacactcggagagtgtgcaatgaagaagacctggggccccggagcaatataaggatacaggatccaggattcagaaaaagagaggaaaagctgggcaagagagcaaggaggaacagggggaagtgtgagcctcagaacccaagagaaatgttaatgaaaggccaaaagatgagaaccaagaaggttctcactggcaaccttaacggaagagtggggtacagaataggttcaagaaggaatgtgatgtgaggaagtcaaatccagcgcttggaggccccggctttgggacagagaattggtccctgcagagcacggtctgaggccagtgtgactttcacctctgctcactgcaggacaaccagagagctccatcccaggctgagctgggctctgaaattaaaaggtggattgaaaaggttccttccccttttgtgtgtatgtcggggtaggagggggtggagggtgagggctgctggaagaaggtgaggaatgaaacaaaaatgggcaatacattctgataagcatgtaaacaggggccaatgcaagggtgtatggaaacagaggaggctcccatcccatttgtccaggtctgttcagtggaggacaaggggagtttgaaaataaaatgcccaaggatttaatcaaccaaagagccaggaccctccatacgtacgatgttgccatgatgaccatgcccgtgtgggtggtagtttggccgtttcctatccaaggcggacgccccggtgggcaggggtaggtgggaggcctgtgtttccatcctgaagcttaagaaccaggccggcccatctcgggtttgtgtctgggcacatgcaccctgtgggtgagatgcaccaggtcattgtaggccacaggctctggaaagggcacagaacacggggcctgaagcaagtcacttcagctcagaacctcagtttccaagcctgccattttggggaactggggttcatgataccagggagtgaaaaattctaggtataatacatgaccagcatttctttctacttctcccacacgattcccttttcagcagattaaatgtttgtgagccaaagcacaacgtgggcttcgcttctctctgcatgcttcagccttgtccagacatggcgtgtcacctgtgtctccggcagtcaccagctgtcctccaggctgctgctgtgggcttctcattggtggatccgaggtcctggatactgtcgccttggtgaatgcacagtgatgcgtgtggggaggtgcagaagctcttccgagttattctctgcacttacagattgagtttatcccgtgatgaagctcaaaatcagttatgcttttctatctcctctgttgtatttctcctcaacgtccacttctgtgagtgagtaaggttgtctgttttgacagctgaatgaacagaaaaaggaggttttaaaagcaaaagtctgctgtgtcccagtttcccagttaactccattctctctagccattcatggcatggagacagaaaaatcacagagcaatcagagtgcattttctgaaatcagtctcaactgcggagtgggaacgtgccactctgaggaacttccttccggcccggcttttgtgacatgtcgtgtggtagcggtcgtattccatcccaccttgtcctccaatgctgagctcaaggatttgggaaagcacatggtcccaccccgaggtcacagggagggctttcgccacagcagatgtgtgtgccgttcacatgtcctcgacagccagcggagtcacaattgattttgatgttaatatggcaaaatccattagggagaaaaactttcccccattcattgactcacaacccaagtagaaattgttttttgacattatccacattcctgttcttcccatgaggcatatttgaggcgggcagatcacctgaggtcaggagttcgagaccagcctggccaaaatgctgaaacaccgtctctattacaaatacaaaaattggctgggtgtggtggtgcgtgcctgtaatcccagctacttggagaagctgaggctggagaattgcttgaacccaggaggcggaggttgcagtgagccgagatctcaccactgcactccagcctgggtgacagaaaaagactgtctcaaaaaaaaaaaaaaaaaagagctgacattctaggtgtttaataataccatactatcatatctagtgtgataaaataacaacatgcattttccacaggactatatttcaaaagagtatgagatgattatattatatttttagaccaaagtttcactgatgcagaaaaatctgtaagttgcaggtttatttttaataaacaaaatcgactttatgcaccttgtaggttaacctaaccgacattattgtaatttattcagtaggtagggaagtttgaactctactcttgaattcatggcgggatatattaatagtagggagcatgcggggaagtacgcagacattgttagcaataagcagtgaacacacagggagtggtgatataaagataaaccaatacagacagaatgtccaaataaggccccagtagggcatgttttccacgtttcctagcagggttgggaataccctatttagattttcagaccagaaaagggtaatgaagtcagagagattagcctgggcagaaagggaagaatggaccaggggccatccattcttccctgtgctggtgagagcacaggtcacggctacagagaggggggtcaacctaaggatgcaggcagggttggctataacagttccttgggaaatggaagtgtaggaatattgttggcttagttttaaacccagaagaggaaatagctctggaacttaggctgggggatgggggcagaaaggactcaggtctttattcctagactactccagtacatatcttaccccatgggcacctgtatcaacagactctgagggaaaggtttgcagcagacatggaccttgaaaatgctggaaaaagagaaggtgctgatcctccccaggaatcagaagaccaaaagccttagaaactcaaagaaagaaagctatagcaggggggctactttggctcccagacttcagctctcagggccaacatagagctatgatttgaggactgttctttccatctgtattagttagaattcctccagagaaagagaaccaacagaatacaaacacacacacacacacacacacacacaaagatattgagataaacatctcagtatatatgtgtgtatatttatatacacatataaaatttgatgaaatgtattttaatgaattggcttaagagactgtgaagcagtagtagatccaaactatgcagggttgaccagcagactggagacccaaggaagagttacagttagattccaaatgcagtctgttggcagaattccttctttctcaggaagggttagtctctgttctattgtctttaactgattgaatgagatcccccacattttgaatagtaatctgcttttactcaaagttcaccaattaatttattaaattatttatttgagatggagttttgccctgtcgcccagactggattgcagtggcgtgatctcagctcactgcaacctccacctcccaggttcaagagattcccctgcctcagcctcctgagtagctgggattgcaggcgtgcgccaccacacctggataattttttttttgtatttttagtagagacgggatttcaccatgttggccaggctggccttgaactcctgacctcaggcgatccacctgcctcggtctcccaaagtgctgggattacaggcgtgagccaccgtgcccagcccaaagttcaccaatttaaatgttaatttcatccaaaaaaaaaaaaagaaacatccagaataatgtttgaccaaagatctgggcactgacctggccaaactgacacataaaattaattatcacaccatcttaacactgtccctgggtaaaggactaaaaaagaaaagacagaaggaagaaggagctaggacccagggataggtaggatgtatcaaggaataagaatcagcatactgtgtttccacaaaacacaagaaagaaagtaaaaatctagaaagatctgcagcactgtttaattcagtacatgtgcctcaggtatttctgggggctggttggggggccagtcccaggcaaactgaaggtgcggaagcggtggtgggattagcttagtcagcaggcctggtacgcatggactagttgcataaagtactggaagccttggacctgatggttgtcttcagagtaaaaaaggaggtaagcagaaaaatgcagtctacaagctgctgagtcagttaccacttagcatgacttgagtgccaaagatatgacaggcatagagtagtttggggcacagaagaacagatcagaggaggttacaggtttttgtgcatttaatccttacgacaaatttatgagacaggtgctgttctttatcctcattttccagatgagaatctaaggcatagaaaggtttagcagtttgcccaaggctgcacaatacttgtgatgcttaattttgtcttaacttagccaagccgtggtgcccagttgtttggtcaaacatcagcctacatgttgctatgaaagtatttttttagatgtgatgaactttttttttttttttattgagacagagtttcactcttgtgacccacactggactgtaatggcatgatcttggctcactgcaacctctgcctcctgagttcaagcgattctcctgccttagccttccgagtagctaggatcataggtgcccaccaccacacccagctaatttttttgtatttttagtaggaacagggtttcaccatgttggtcaggctgctctcaaactcctgacctcaggcgatccacccgcctcggcctcccaaagtgctgggattacaggtgtgaggagtcatgcctggccagatgtgatgaacatttatatcagtagacttcgagtaatacatatttcccttcataatgtgcatgggcctcatccaatcagtagaaggccttaagagcaaagactgaggtttcctgaggaagaaggaattctctttaaaactgtcacatggaaactctgcctgagtttctagtctcctgccccatggaattcagattcaagactgactgcaacattgactcttacctgaatttccagcctgtcagttttccctacagattctggacttgccagtccccatagttgtgtgagccaattccttaaaatagatctctttctctcagcatgtgtgcatattacagttacatataaatgaggctctgtctctctctccatactgaaagcaggaagtagaagaggaaaagaaacagaaatcacatttttgtcaaatcccagaggcacttgcagtccagaatcttgtattaggaagggcagtgggtgatggggcaaaccttacctcctggatggggctgtcaggacttcatgtctccatggagggggcccaccccagaaccaccagctcagccccagccagcaaaagcctcctggctcttcaggagcctgctatcacagggaacccaagtccacccacgtcaggctcagggaccttggagggctttgtcctgcgattacattggtctctatccagcaaaagaaaagttggaaagcagtctgtgtgctttctaaatgaacacactgtgataatgggggcccaaagtacatatttctaataacaaacctgattagaggtaaaattaattgtatatgctatttaaacatagtatatgttgagttgtatattatatttttttacaatacttactcatggttgtgccttggatgcttatatgccataagcaagttaaagaaaacatatggcttacataccaactattgacattccattcatgcctttattttttattgtttatttttattttttttgagacagagtcttgctgtgttgcccaggctggagtgcagtggtgcaatctcagctcattgcaacctctgcctctcaggttcaagcaattctcctgcctccacctcctaagtagctgggattacagactcccaccaccacacccacctaatttttgtatttttagtagagatagggtttcaccatgttggccaggctgatctcgaactcctgacctcaaccgatctgcctgccttggcctcccaaagtgttgggattacagcatgagccaccatgcccagcctccattcatgcctccagaggtgggaaggacactgcatggagtagggaccatttggatcgttgctttgtgttctcattttatgcaaattcttcctatcagacagtctgtacctgcaaggaatagccatgaaggcttaccgcagttcaagtgttactctagcccacaaaacacataatttatgagccaaaagagaagctggaggccatttatgttggagcaacttcaaaatgtctcaccagcaattaagactatttttgttttcctttcggagaagcattagcacacattttagagaatgaccgcttaatttataacctcttactcatattttagaggtttactactgaagggcagagttatttggaatgttcggaatgagttgcatcatcttgttttaggctccagcaaagaacaaaaactaagaacagacaccaggcacacacttcaacggcatcaagtgcccacagtcaaatggagtcaagtgcccacagtcaaataccattcttctcatactgcggaacaaccaaaaaaatcacacagtggcctaagtatgtcctagaaaatattagcatcagcaaaacaacgtgtaagtagccaaaggacgcagtggaacaagaactatgaggagaggaagaaaatgaaaagtaaaaagacaggcctttttaaagattacaaacacaccgagaatgttaacatacttgttacataattggagactttgttcttgatcttcagtgtcaaaagcactgctacgatcgggttgagttccaacccttgctttttcttctgcagcagatgcattttgtaaggtcctatgggtttattctgcattataacacaaatgggtatcacatttctggcaagctcacccactggttgcttttcttttttaaaattataacaatatgttgctggagatttagctatcccaaattgtatacaaaagaacaaacattattcagtttacatttctctaaacaaacatccattcattcattgaaaaataagtcattaccagttgttcaaaataaataagtgcttgtctcggctaggaatagagtggccctttttcaaaagtgcatgctgctatttttctgaacatgcggctttgagaggaaatacccacattcttttttaatttaatttaattttattttattattattatactttaagttttagggtacatgtgcacaatgtgcaggttagttacatatgtaaacgtgccatactgctgtactgcacccattaactcgtcatttagcattaagtatatctcctaatgctatccctcccccctccccccaccccacaacagtccccagagtgtgatgttccccttcctgtgtccatgtgttctcattgttcaattcccacctgtgagtaagaacatgcggtgtttggttttttgtccttgtgatagtttactgagaatgacgatttccaatttcatccatgtccctacaaaggacatgaactcatcattttttatggctgcatagtattccatggtgtatatgtgccacattttcttaatctagtctatcattgttggacatttgggttggttccaagactttgctattgtgaatagtgccgcaatgaacatacgtgtgcatgtgtctttatagcagcatgatttatagtcctttgggtatatacccagtaatgggatggctgggtcaaatggtatttctagttctagatccctgaggaattgccacactgtcttccacaaaatacctaggaatccaacttacaagggacgtgaaagacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcaatgccatccccatcaagctaccagtgactttcttcacagaattggaaaaaactactttaaagttcatatggaaccaaaaaagagcccgcatcgccaaatcaatcctaagccaaaagaacaaagctggaggcatcacactacctgacttcaaactatactacaaggctacagtaaccaaaacagcatggtactggtaccaaaatagagatatagatcaatggaacagaacagagccctcagaaataatgccgcatatctacaactatctgatctttgacaaacctgagaaaaacaagcaatagggaaaggattccctatttaataaatggtgctgggaaaactggctagccatatgtagaaagctgaagctggatcccttccttacaccttatacaaaaattaattcaagatggattaaagacttaaatgttagacctaaaaccataaaaaccctagaagaaaacctaggcattaccattcaggacataggcatgggcaaggacttcatgtctaaaacaccaaaagcaatggcaacaaaagccaaaattgacaaatgggatctaatcaaactaaagagcttctgcacagcaaaagaaactaccatcagagtgaccaggcaacctacaaaatgggagaaaattttcacaacctactcatgtgacaaagggctaatatccagaatctacaatgaactcaaacaaatttacaagaaaaaaccaaacaaccccatcaaaaagtggacaaaggacatgaacagacacttctcaaaagaagacatttatgcagccaaaaaacacatgaaaaaatgctcaccatcactggccatcagagaaatgcaaatcaaaaccacaatcagataccatctcataccagttagaatggcaatcattaaaaagtcagaaaacaacaggtgctggagaggatgtggagaaataggaacacttttacactgctggtggaaatacccacattctttgcaatatttaaaaaagggcttcatggaatcaggggaggaaggaaaaggaggcaccagaatcactttcaaatatggcttcttcctgagcctctgaccgatgatgcgcacgacttccccatcttgggcttgggtttgggcttggtccctcttgagcttgggaaccagaatcagagggggttctggctgacttctaagactcaccagttgaactcgtcttgctcttcctcgggatctgaccatgatttctgcctctgcctggacagcaccttcacagcacacctggttgaacgcttctgccacttggttccctcataggcctttccaccctgcttcccatcaggcccaagaggcaatggtccccagcaaagagctgatagcacatggattgaaaccttctgtgggtcccctttaactctcaaagcccgccccacgcacctcttcacccacccctgcccaaaccaccctccacctttgttcacgtcttctgctcctccagctcctgaaggcggcgtccatcctcccatcatcgtgtagtcagtggcagccctgtgcctgctggttgtaaacacataagcatgcaatcacactgaatcacgtcactgtggaaaagcccatcccaagagacaagctatgggaaagatggtttcgggaaccactttccctgagctttcctggtatgttcacacttcaattgcccttctagctctagctcttgctcatcttcccaatgggagaaggtcaggaacaaaagaaatgtggtggccactttaagaggtgggaaatgctgtagggatgagcctcttgcccctactccccagtccctgggaggtggctcttcccctgtaattagaggtgccagtcattctttttatggtacaagtgacctgttgcaacaaccagtattgtccacaaacaacattaaaatgtggatataaaacatgaagagacagtataggacttccaggccccatgaatatcactagccatgatagcgaaataccgcaggttcttgccttcagctttgtgctgaattgataatcctgccttctacggagcactctgcagccacactgctcacttggagctttcttgctgtgctaccctaggatgcagttatttaatagtctgtgtttctaatcacggcagctgattgtttttgtatcacaagaactataaggcttcctcagaatttatatgagctgagtctaccccatacagtgagaggaaatggatttccttctgaagttggatgtcgttataaccgatcataaatcaccctctttgggggcacccacaaagggtgagccccattgaacacagatggatcacccagtgctgagagggacttgagactttgcaaagtacttgctttatagcctgggattgattattacccagggcatcacttacaaacattagtctgaaagtctacattctgaccactggtatgacattcaggtagcaaaagaacttgaacattttcagattttcttttttctctctttcttttcttccttccttcctttctttcttttcttttctttttttttgagacacaggtattataaggtattataataataatacattattattattatttttgagacacagcttcgctcttatcactcaggctggagtgcaatggcatgatctcggctcactgcaacctccacctcctgggttcaagtgattctcctgcctcagcctctcgactagctgggattacaggcacctgccaccatgcctggctaatttttgtatttttagtagagatggggtttcaccatgttggccaggctggtctcgaactcctgacctcaggtgatctgcccgcctcagcctcccagagtgttgggattacaggcgtgagccaccacgcccagctgagaattttatttttcaaaaaaaaaaaaaaaaatctcaaaaacaatctctccagttaaactctggtaatataattgctatatctttttttaaaatacaacttttaagtagttttagattctcatggaagttgcaaaaacatgtagctttcattcagctacatagatgaataaatacttctcagaaaaaaattgtattacatgacagcctaaagtaacataagaagccattcataagtattcattttcaccaacttgactttttcaggggattgattattttattcaatgttatgggggctgtggaatggaagggcttgtaattaacccacaatttgccacaactatcctaaaagccaagggcaatttttccagagacaaatcttaaaatatatgatgtcaatatattgtaaaatataaaagcttaactttattacaaaagcttaaaatataagcctgggcccttatggttctgtcttggagaaatgtaggcaaatgaagaccagcaaccaaatgctgcttcaaaatagttcaaatccttttcttgcaattctctaaaacctgaataggtccacatgcacacaggccatcgtatcacaaaataggaattccctgttcttgcatctgtccccgttactcctgcaactttcccagaacatccgctgcagttaccttccccaaacccttctcttctgaccagccctgttcaccttttctttctcacactcttctttccctcccccactcttcatttctttatgacattggtcaacccaaaccctctcctagcaagaaagaatcttttctcttgagaaggaaggaggttgggaaattagaataggcaattataggtctctctttggaaggctgggagaagagaaacagttgggaagacttccatgccagtttttttttttttttgagatggagtctcactctgttgcccaggctggagtgcagtggcaccatcttggctcactgcaacctccgcctcccaggctcaagccattctactgcctcagcctcccaggtagctggggctataggcatgtgccactacacccagataatttttttgtatttttagcagtgacagggtttcacctcaaatgatccacccgcctcggcctcccaaagtgctgggattacaggcgtcagccacctcaccctgccccatgccaatttttttaaatgacaactttattgagatgtaatgtgcataccacagaaatcacccttttaaatatatgtaacatatttaatatattttaaaatatttactatattaaatattaacatatttatatttatatagcatattatataacatatttattatatattatatatttattataatatatataatatataatatattaatataaaatatatactatatattatattaatatatcattatatatgattacatattataatatattaatacaatatattatattaatatatgatattatattatcatatattatataatatatgatatatcatatattatataatatatgatatatcatatattaatataatactaattattataataatatattatataatgatatataataataatataataattatattatatatttatatataatattatattatattatttttattatttattttttattttttatttttttatttttattttttatttttattttattttattttattttttaaatttatttttatatttttattttattttattttatttttttattttttatttttattatatattatattatattatattataatattattatataataataatgtaatatattatattatatatatttatatcatattatataacatatttatatttatataacattatataacatttatatttaatattaacatatatttaatatattaaatatatataactatatataaatatttatattagttcagtagtttttggcatattcacagttgtgtgcaaacatcataatctaatctcagaacattttcattatctcaaaaagaaatactgtatctgtcagcagtcacttcccattcccccactacttctgctcctggcaaccactaatctactttgtctctgtggattttcctattatggacatttcataggaacggaaacctacagatgtacgttttgtgatgggcttctttctcttagcataaagttttaaaggttcatctgtgttgtagcatgcatcagtaattcatttctttttacaaaataatattctgttgtgcagagagaccatattttgtttatccatctggttgatgggcaattgggttgtttctactttttggctattatgaataatgctgctatgaaccttcttagaccagtttttcatggacacattttcatttatcttgagtttaggaaccaagaatggagttggtagatcatacgtcaactctagcattttgaagaaccatgatcatttttgtgcctctacgtgcagaatgaaagctaagtccagcttccttaacctattaatattttatgtcttgcacttaaaaatcctcattaaaacaagaaagatataaatatttctataagatgattagaaatcatccctcaggttgtgtcaggagctgtgcacggttttattgggcatcacagatgcttacttctatatcacgagattttagagagaagcattgggtatttttattaaagtaaaaatcaatgcagggttgaaactcatgattacatactgtggctgggtacctgatattttggttagatcataattaagcttactactttttagagcaaactatgtccttacctttgtaataaagaaaaaaacaggtgagtaggtaagggcagaattcctccagatgagagcagaaagcacagaaggcacttgcacctttgaaaaggagctacaggagaaaagcctccactctcttgggatagcaatcctgagggaggatctctcggtactcctttaaggagaacagccatcagacgccaagtgcgggagcgcctgactcacagtgaattccttcaggatcttctctttataactcatcagtatccgagagccacttgttcctcttctccttttctctctgtgttcttgtctcactgtcataaaaccaagacttggctcttctctcaaacatcctggtgtgtggagaactcgggaaatatctccctcctgggtcttgctgctctgtgccctccgtgggcaatgtccacaccgcaccgacacctacaaccaaaaccatactgccacctggaattattacagatctgcgggaggaagggaggcttcagattaaagccaggagctgcccaatgctgaccgtcctgtcccaagacaattgtgctgcactaatcaaccccttgccgcagtaaacttcaaaagacgaaaagagatgcagtctggctaacccctgatcaatgtaaatccctcctttatctccaaataatcatttccccagctccccacaccctcaaatgatgactttcaacactttgaatataacaggctcacagtctgtattcaatggtctcatcataaggcaggaagccctatcaggaactgcgctgctctcctatccctacacttcccaccacgtagttcggggttaggcagggaattgcagtaaagctatacacagtaaagaaaagttggtttgtgtgtgtgtgtgtgtgttgtttgtttgttttttgagaccgagtttcgctctttgcccaggctggagtgcagtgggacaatctcggctcactgcaaactccgcctcccgggttcaagtgattctcctgcctcagcctcccgagtagctgggattacaggtgcatgccgccacagccagctaatttttgtattattagtagagacggggtttcactatgttggccaggctggtctcgaactcctgacctcaggtgatccacccaccttgacctcccaaagtgctgggattacaggcgtgagccatcttgcccggccggcatttcagttttattaaactgtctactgcatgccagttcttagtagcacagtctctttttttgttttagaaactcaaaaccttctaagtgatcacctggttaaataatgcaatcccataaatgacccctctcttctgatccatgcctggtgtccatttaattaaaccagattagaaaaagggattattgctggctcagggaggctgctgccacagacaatgcctcacttcggattgtgcagatataatatgattgctccaagccagccttcatgtttacacctgcctggaagctctcaggccctggagtaacctcaggacactcctggccctgtctgcgggtaaccagttcttctctcagatgtgcggtctgtgctgttcctccccatctgccagtacaagtaaggtgtggcacctgggcccttctcccactcacattgcctgtgtcctctctctaaaagtcaccttaagaccatgcgggtaaagaggagtgacttaaaggagctcaaattcatcttacttttttccagttgggaaattggcaaaaagttctgtagttatggaaatattcttgccagtttatagaagcaattagatctttttctatagcatctgtgtggaagatttccttttcaggaaatcaaaactcctttgagtggcctgacaatagtaaccataagaaaataattttcctggaattgcttctgagctcgtttgtgaactggagagtataactttgtgtcactatactccattttactaaccatgtggttcagatgctttgtcattttggagccttggtgaccctggagagactgcgtcttccagggttagccagttcctagagatagcaaagaacttgcctgaaagcctgcctttcatacacaaatcaaccaatccattacagaccagcctggccaacatggtaaaaccctgtctctgctaaaaatacaaaaaattagctggacatggtggtacatgcctgtaatcccagctactggggaagctgagacaggagaatctcttgaacctgggaggcggagcttgcagtgagccaaggtcgcgccactgcactccagcctgggcgacagagcgggactccatctcaaaaaaaaaaaaaaaaaaaaaaaaaaaaaaaaaatcaagcaatccagtgctcataccccagccccctcctttctcagactcctatactctgggccaggatccacctgccctagtcaccccagggccagctaccagaatactacggacagccgtatgccccagtcaatcatgccccagaaattattcaaaccagtcagtgctaagtctgcttaccctgcctcacctgtcccttcccgtggaaaccacaagaaaggctcttgccctcgttttcctcctgctctgtctcctgacctacctggtgccccttcctcttgggaacagtaaaaaactctctttccagcagcagtcatctcctgatctgttggcctcatcacacctgaatcataataatacctatctttaataacagccatggaaagtataaacctggggttgggctgggacaacattgtgaagctcttttagcttcatgaataacggggccgggggcagtcacaatccctgctacactcttcagcagtagcaatttctggaaatgcagccctcattgaagcttccgagagaaagagtgccatcttgtggtattttgtagtttcttaggccatttcctttctctctcgctctctttttttttttttttttgagactaagtcttcctctgtagcccaggctggagtgcaatgacacgatcttggcttactgctcactgcagcctttgcctcttgggttcaagcgattctcctgcctcagcctcctgagtagctggcattacaggtgtgcgccaccacacctggctaatttttgtatttttagtagagacggggtttcaccatgatggtcggactggtcttgaactcctgacctcgtgatcctcccgcctcgacctcccaaagtactgggattacaggtgtgagccaccgcgcctggcctcctctctcttttaaatagatcatttttagagcagttttaggttcacagcaaagttgagcagaaagtacagacagttcccatatagctcctgcccctacacattcacagccttccccactaccaacatgggcaccagagtggtccatttgttacaatcaatgaacctatattgatgcaccattattgcccaaagtccatggttaacattagggttcgctcttggtgtgttggatattttacggatttggttgaaagtataataacatgtgtctataattattgtatcatagagagtagtttcactgcccccaaatcctctatgctctgcctattcattcgtccctcccttcaacccctggcaatgactgatcttttcactgtttccatagttttgttgcaggccatttttactccaagattttctttgtttggctgtccactttgtgctgggtgtgtaatatagactcgtgatgagtaagagagacagcctggagcatcttggagtccatattgggatggactcatgaattcctgtattttcctactccaggaaagaggtgcaggtaaggatagaaaaaaaagtcaagtagacaaataaaaataattaggctgggagcggtgacttacgcctgtaatcccagcactttaggaggctcaggcaggtggatcacctgaggtcgggagtttgagaccaacctgaccaacatggtgaaaccctgtctccactaaatatacaaaaattagccaggcgtggtggtgggcgcctgtaatcccagctactcgggaggctgaggcaggagaatcacttgaagctgggaggtggaggctgcagcaagctaagatcacaccattgcactccagcctgggtgacaagagtgaaactctgtctcaataataataataataataataataataataataataataataataatgtattatttacaggtaaagtaaattctgtagtgttcaagagataaaataaattgtctcaagcaaaagtcaaactaggatgatttttttttgttattcaacttatttagaaattaggtttttttgttcctgttgaattgttttgttctgtcttaggtactaaaaataatctttcattctttggagctgctgatatttactatgacaggcaaacaattgcccttctccataccaccacatttttgttgttaatattcctggtgtccataaatgtttttgcttctttctttttttgtctttgcttattcaattacctttacctagaaatgccatctccttacatctgtctatgcttcttaaggactcgcccaaatgttatctcctgcaagcaacagaaatctccactagctcaccaccacctctaacttcttcctggatttacctatttaggcatcagttatttactttttactaaaatacatgagaatttagctcttataccacccacttccccttcctcaaatattatctttagtcatataagtaatctctaattatcattaggactttgtagaataaagccaagttttctagaatatttaggataggatatttcttttcttggcgctgctttttgttttgcaggtcttcctcatagtagtaatttttaatttaaaaaaatgctgttgtagccctttctgtgagatctccttctcttttgaagcctttggctcctctgagcccatcttggcaggttgttctttcggttggctgtgcagatgccatcttgaggtttttcacatctcctctcctagagtagatccattgtttcctggatcccatgtcatctttcttggcttaacctttctcattttccctgacaacatcctcaaataaaactctaagaaagcatgcagtggtatcttttctgagctctagcttccaaaaaaatatgacccagtgtttgagttttggagccagtccgagataggtttgaatcttggttctcctacttattagctgtatgtccttgggctgattccctaattgccctatgcatgaattttccatttgcaaaatgggggaaccagtaatagtagtagtacctatgtttttagggagctatgaggatttattgaactggtacatgtaaaccatttagaacagtgcctgctgcatatcacatccccatcagtattcacgtctctcatattctaccctcacacttgattgatagtttggttgattatatatttctaggttgaggataattttaccttaaaatttcaaagtctgtgctgttgtcttctaaccagtcgtggtggtgaagcctcatgccatcctgagtttcacttatttatgcatgactttctccctggaagcttttaggagtttgtcttttccttgttgagctgaaatagcacaacagtgtacttagtgtgggtcttttttcattcattgtgctgggtacaccaaatggacaggcctatggataggctctttcaaagttggagtcttgaatcttgtcatatttttgttgttaactttctcttttccattttatttgttcattttgaagtgtctgttaattggattttagacctcttgtcttgagtctggtatctcacattatttctaaattttttttaaattttaagttctggaatatttttcttatctttcgactttcaggaaattttatttggactatcataactttaagttttgttttggttatttattgttgcttaaccaattatcccaaaacttaatggcgtaaaactacacatatgtctatctgtcactactgtatggattaactggggctagctggacagttttcttgctggtcttatttggcagctctcactgtgcggtcagacagtgttagggactggtcatctggatgctcagctgcagtggaatgtctgagacggcttcttcacccacaggtctgctgctttggtgtttcttcatgtggcctttctctctgcatagcatctcatcctctcgaatctcttcatgtggcttttctttctccaagagggtagccaattcttatttttggcttccagaagcacagaaatggagctgccaggggttcttaaggcttagacctggaacaggtccagtgtcatttctaccacatgctataggttaaagtgagtgttggggccaacccagattgactatgggatgggcctgtctaaggacatgatgacaggaggtatggctcattggagaccaactcccaagatggagcatgagttctaagaactttttcttctctgattatttcttattcatattgttttgttttatacatgtaatatattcacaagtgtctttatgaagtgattttgatactctttgtcttctccctggcatctctttgttctttaataattttttttcttagtttattttggtcttatttttctttttaaagcctttccttaaatatctattctatgttgcttatcatttgtagtcttttttttttttttttgagacccagtttcgctcttgttgcctaggctggagtacaatgatgtgatctcggctcatcacaacctctgcctcccaggttcaagcagttctcctgcctcagcctcccaagtagctgggattacagtcatgtgctaccacgcccagctaatttgtgtatttttagtagagatgggatttctccatgttggtcagtctggtctggaactctcaacctcaggtgatccacccaccttggcctcccaaagtgctgggattacagacatgagccaccgcgcctgacctgtagtctttttctcattcctttatttgctcattcatatttgagagaggtactaaaagactgggagccggggtgtggtggctcacacctataatctcagtgctttgggagaccgaagtgggaggatcacttgagcccaggagctcaagactagtttgggcaacatagtgagaccccatctttacaaaaaaaaaaaaaatagctaggtgtggtgacacccatctgcagtcccagctacttgggaggctgaggcaggaggattgcttgagcccaggaggttgaggctgcagtgagctctgatcatgccactgcattcctgcattccagcctgggcgaaagagcaagaccctgtctcaaaaaaaataaataaataaaaataaaaataaatcaaaattgattgggagttctttgtggccaagacttgtcaactgatagcttttagggggaatgtatgctgattcctaattgttatcctccatccctctatcttatctcctggtgcaatcataaatgatggctggatgactactccattcctctggatgtaaaatctacattgtcttgcctgaggtggatacgtttgcttgggttctgtttaaggagatggggccagcagtgtgtttcagggcctgtgaaatgtgttctctatccgggcttttgcttaatctctgttttcagtcttgcctatcagtcccactgtcgggggtacctcgtgtctgggtctagaacctttccaggttgctgtgggacagattagcctccttgttctcagtatccccctgacctccacctttgtttgctttgctccatgaattaaccattttccatgtactgtcattgtctaatgaagatgaattctcttctgttggtaaccccattccttttttgtaattgtgtgcttatacaatgtttattcttcactgtatttctattggagcctcaggacaaagagcagatggtaagaatatgtgttcagtgttaagttttccttctgtaagacatctgcaacttgtgtttttcactgaatagatcatggacttaatgcatatagagctactttgcttttcatgattttgccttcaattatatgtagaaatataatttgtgaattgcctaatgaatttttcctaattttgaatcatctttgcattcctataataaacactgttagaatggctgtggtaatattttatttttgcatttttacttctgtattaaataagattatagttttgtttgtttccaataaggctgttatttcatttcagtatcaagggtatgcagggctgagttgggaagctttacatcttttttctaagatctaggatgtagatctggtttacacagtaattttcaactgcaggagtattttgcctcctatgggacgtttcgaaatatctggagacatttttgtggttacaactggtcaaggtcgggaggtcttattggcattctgtgggtagagggaatgttactaaatgtccgacaacacaccaggagaaccctccacaaagaattatctggccaaatatatcagtattgctgaggctgacaaattctggtttaaataaatatccaatttggaggatgagtctttgtctttttccttcttctgcgtattggtctccagattttccacttcttcagttagtttttgtgactgtagaatcttaaaaaaaaaaatgaaaactttggccgggtgcaatggctcatgcctgtaatcccagcactttgggaggccgaggcaggtggatcacgagatcaggagataaagaccatcctggctaacatggtgaaaccctgtctctactaagccaaaatacaaaaaattagccaggcgtggtggcgggcgcctgtagtcccagctactcaggaggttgaggcaggagaatgttgtgaacccgggaggcggagcttgcagtgagccaagatcgcgccactgcactccagcgtgggtgacagagcgagactccatctcaaacaaaaaaaaaaaaaaaaaaaaatgaacatgtcatccatacttctaaggtgttgtaaagatgtgtaaagttttcactttttgcatcatattcacatgtggctatatgcccttttctcttcaaagttttctttatcttgattacttatcagaggcttgactgttttattatctcagtcttttgaaagaatcctcctttagttttattttttaaatctagtggtttttctttttcctttttccttaggtcttaattatttccccctttttgtttgctttgcttttcctagtttagtggatcaatgtaatttaaattgctttttaaacaaacatgtaagggtatacattttcgttgggtgctgtttgactttgttgcacaagttttaaaatcttttttttaatagcttgtattttctaaattattttattgcatcttttgttcacattgctcttactattaattttttatttttattaattaattaatttatttatttaattattagatggagtcttgctctgtagccaggctggagagcagcggcatgatcttggctcactgcaagctccacctcagaggttcatgtcattctcctgcctcagcctcccaagtagctgagactacaggtgcctgccaccatgtccggccttttttgtatttttagtagagatggggtttcaccgtgttagccaggatggtctcgatttcctgacctcatgatccacccaccttgggctctcaaagtcctggaattacaggcatgagccactgcaccctgcccaaaaagctttgtgtttttacagatattagacatgtttcttgtttaagaaaaaaaatcttaacgaaaacgtaggagaataagagaaacatttttccaaaaaagagaaatcattgtgattattttatcttattagaatgttggataatatagtctgcttcattaatcatcaagcatgctatgcattttccatttttataggatctgtatctcagttaaggtaatactggtaatttttgtactgtaatcaaagatgaaaaatataggccaaaatcatggaccttgcatagaagctggataatgaagacagctatggagaaaaacatagatacacacacacggacacacatatatataaagtatacacacatatattttttaaagttttaaagcttttaaagcaaaagccggcccctcttctcttccagagtgggaggcctctcccctctcttagagtgggtggggagagcagttgccatgggcagctttccttgtgagccacaggtccctctggacacactgctttctggccacgccccctttccttttcatctttctcattgaccaatgggcttggagcattaaggccacgcccctattccgcattctactggggccctggttacgcctcctctggctcagtcacacagctgcctggtaggtgactggaggccttgatcggttctcattgagattttgctgctgtgaccccaaccctgcctccctccccaccctgcgatggcagaagaaactcaacacaacaaattggctgcagccaagaaaaaggtaaaaacgcactaggtcatagcccctcaacccagccacagatcccctctgatgacaagacccctgccagagtctatacgactcctgaggcacactggactggtcccccctaccccggtgcctctgggctacccccaccaaagttttgtcagtcagccccaccccttcagcaagcagcccagtccttgccctcgccaatcaccccagggtgactttgggtgggtgagtcctggggcttcccgctccattactgggccctcatctcctgccgccccaagcttgatctccctgggctctttgggctctcatctccaaggagccaggccccaccctcgccagtcatccctgggtgactttggactggtgactcctgggactccctgctgcagactgtgccctcccctcctgctgcctcaaggtcgacctccctgggttctttgtgctggcgtctccaaggagctgggtcccaaccctgtgcttccctcccccatcgtggagcagcgacttggacatggtgctgacatggtccctccccccgaccaggaggagtggaatgttgtgatgtcacagtccacctagtaactgctgttactgcaagactggcctttgatcttacgacccagtcccctaagcgttctcaccccgtttctggttcctctggtcacagcacaaatttccagctggaaggggaatggagactatgggacctaggagcaagaggttccaggctgcctcactcccttacagatgttgacggtgggaaaagcctacacttcccccatgaactcaaaacgttgacagtatctctgggtggcaatgagagaatgcgtttggtttggttttctcccaggcttctactttccagagagattttaacatttttttctgagttctccacctcatattctaattctccatggttctgggaccagactctccttcagtcagtggtctctgaagtgacatttgctcatcttctgtggaatagatcttgggaaactgaacttgacaccttgaatcttcctcatattatctcaaccttgggtactttgagtgccacaggataaatgtgggacatctttctgaagcatcagtttcccttgattctcttgagatcaagagaaaaaacatgaatgtacttagggatgacagtcacataggtttctaagagtataccagacctctctctgaaatgaggcttgggttgtcctctttctgataaattctgatttaagagaaaggctgccttctgccatgaggacacattgatataagagtttgagaggtactggtgcacttcttcacactaacagacgtgtgaggatgtatgactctaaaccacatggcatacagttcctgcctacttaatgtttacttttctacctctgcctctggttttggtccctggcagctgctgattcttggcaaaacctcagagcttggagtcagaagactgagtttcaaagttccagtattgcctttttctttttttttttctagccatgatatcaatccttctcagtcactaaatgagtgtgacaacaccttgtacagttgttggtgtcattaaatcagatggtgtgtaagtgtattttgtaaaaactgtaaaggaggatgtggctgtaggggctgacggttctcatgagtattactgctcttctttccaacagttaaaagaatattggcagaaaaacagccctagagttccagcaggagcgaacaggaacaggaaaacaaatggcagtatccctgagaaagccacttctggtggttgccagccacctagggatgtgagtcttggctgaccaggcttctggggacagggggcccaaggggcagtagagggtaattgttaagattgtggatggactgctgggtactggttaagaattctggctttagccgggtgtggtggcccacgcctgtaatcctagcactttgggaggccaaggcaggcggatcatgaggtcaggagatcgagaccatcctggttaacacggtgaaaccctgtctctactaaaaatacaaaacattagccaagcgtggtggtgtgtgcctgtagtcccagctactcagaaggctgaggcaagagaatggtgtgaacctgggaggtggagcttgcagtagccaagattatgccactgcactccagcctggtgacagagcaagactctgtctcaaagaaaaaaaaaaaaaggaattctgggtttgaatcctgcctctccatctgctctgctagggatatgatttagggcaagttgctagacctcatcgggcctctcttttcacatctgtataatagaggtgttattgtttcacttccatttgtgaagtttaaatgagatttgttattgttgtttttatgttaatccctagtacatggcctgctgtaaacactcaggacacccaggatatggtttgattttcctcatccccagtctcagggggaaaccaggacaatgagaacagccacttgccatcaggagtcactgaaggggccccaggatgggatggtggggagataagaaccatgagagaagttggcacaaaggagttatgggacaaaaggtccaagataggcagaaaagaaaatgttgccagttgatggggaagaaaggaagtcagagggctcagacactgtgggggacagaacatctccatgtgcactctcatctcttgtagtcagcaacaggtttccacagggaaggccctacatcatctgctaccctgaaagatctggaggtaagaggctctgggcggaggtgcagtgacccttcgggtcaaccctccaacctcctcctccaggtgggactgggtgcccctctgccagctgagacagcccacacaccccagccctaatgattgttctctctacctctccccccactcctgctccacctcctcctctctgcatgcacctcagagcccgtgccaagaacgagcagtagtcctggattcaaggtccgtagaaatcagtcaactgaagaacaccatcaaatctctggtaagagtccactggggtcccctgattccacgctgccaatcctgggctccagtttccccttggggccctgaagaaaggggctgggggtccctggtgcctgggacaaatagggagcttgggtgcccaggcctcacctggagggaccccagagcatgcagcatggctcttcttttgctgccctctttgccgactctctcctctccagacacccctgctcgagtccttgctacacacgccctggggttgttgcctcttggggaagtgctagcctgactggttgtcaagggccccgtatttctgccatgactcagtccctaatttgctctttgattctggacaagccacctctcctttttgggctcgtgtttccagaggaggtagtgagtatcaaaggtctctgttagctctcgagtctgagatttaaaggccccctagaacggaaacctcagggctaagggctcctgtctgtccttttccatcctatatctgctgtaaagaaccgtacctggcccatacatgctcagtaaatgtttattgaatgaacccacttctctaaatcacaagctgccagaaggaggggcctttctgaaactccatctctagaggtttatattgctgtcctctcaagagattccagattcagactttgagttctgtggctgtgggcaaaagccaacaaagacccaaatcctctgtccttgggagcttgaggagagtttaccggttcgtgttcccattatgtctgagaactttgcctttaaaatccattcctggcccctgcctaccgcttcctggtctggggaatagagttgagggggccaccctccatcaccttatttgactctccccacagaaacaacagaagaaacaagtggaacatcagctggaagaagtaacgtgatttcgtttcctcgcaacatgactgctgggtttggggggcactcagacatacaggccccagtctcgtctcacccactcccagcctggggatgaaggctcacccttcagattccaccccatccccacagggcccctgataacctggtcccatgggtgggcctgtcctggggcattggtggcattctgggggcatgtctcttgctgtgccatctctgcctccccctggtaagagctctgtcttcctcttcctacaggaaaagaaagcaaacaacaagaaacagaaagccaaaagggtgctagaggtgagtggagggtgtgcagtttcctcctgtcctccggagaaggtttctttccttctctttcagcacttgcttggcttttctcccaaaggttcaaatccagacattgaacatacagaaagaggaactaaatacggacctgtaccacatgaaacgttctctcagatactttgaaggtgggaatctgggcaccctgtcatccttcaacctggcactttgacaggtcttcagggggagtcctttgggccccatctcaactctctcattacagaaaagtccaaggatctggctgtccgcctgcaacattcattgcagcgtaaaggagagttagagagtgttctctctaatgtcatggccacacagaagaagaaggcaaaccaggtgagtccaaccacctgccccatcccctgggagcctggctttgcagatggaggagtgagcctaaaggtcccttctgcaggatggagtgtcctgcccagaaggcagcatggccatttcttgctacttttttgtatggtttttaatggcagcctggggctgagtcagctgctgtgggtgagttgggggtcactgtgtggagtgagcactggacgcagagcttggaggccaagtgcctgccccgcccttacctgtctgtggtcttgggcaagtcctagtcctaggtggggtattgggtacttgtactgtgaaggtacagaagagtacctttagtatgttaccatttctgtagaaagaggaaacgtgtgtgcgtgtgtgtgtgtgtgtgtgtgtgtgtgcatactgtgataatatacataaaacatgtctgcaagggttcataaaaaattcaggagagagcaacaagatggccgggagatacttcccttctgtaccttctgagttttggactatgcaaatgtatcatcctttcaaaaagtgaacaaaagattaattttccccttcctatctgtgcccccatccccagcaagaaaaacgggcttagagaattggatagacctgggtgtttatatcccagctctgcctaagtgaacttaggcaagcacttaacctcaaatactccatgttttttcatctccacaatagagggaatcatagtaactgtctcctatggtggttgcgaggattaaatgggattgttagcacggtacctggtgaagcattccacaaaggttcaaacagtggtaataataacagtaataacaatagcaatattatctgatctctctgggcctctgttagccagctataaactcagtctcattccctgtccgttccaactttactgagttcttttaaaaaccagaccacgggcttggaaatgccttgatctttactgaccgagttgtatattgggcctagccctagcccttttaaggggcactgtgtggaaatgcccaggctctccagattgaaacttctcactcttcaccatccagttgtccagccgcagcaaagcacgtacggagtggaagttagagcagtccatgcgggaggaggcactactgaaagtgcagctgacacaggtgaggttttctgagggagttatgtggaaggaagatgaccccaggtggccaggagcaggtgaggaccagtgacagcccttcctaagttctgtgcccattcttgcagttcaaggagtcatttcaacaagtccaattagaaagagatgagtattctgaacatctaaaaggagagagggcccggtggcagcagaggatgagaaaaatgtcgcaggaggtgagatctgacccttcagcccccccacattagataggtcactggatctttctggtcatctgtaaaatgggaatagtagagccagaggtggtcatgggtctgggctttgtggaggtgggggcagagagggagagggcagcctgtccagcctccagcccctctctccaaggccctttccccttgtgctttgggcagatttgcacattaaagaaagagaagcagcaagatatgcgtcgggtagagaagctggagaggagcttgtccaaactcaaaaaccagatgggtaagatggggctggcatgacctgggagcaggactggcatcagagggctgtgagggtggcttagagtgccccagggaggtgggtggatggaagggctttgaggcagagggaaagagatctgtgccaggagacggcgagtcttgtcatctcaatgagtctcagtgtctcagtgtccccatcagcaaagagggcccattgtcagccacccgcagtgctctttctctgaaagtgctttggaagactggctaccatctgggtgcgaggaatcattagcagtgaggccaagtttgaggagcctgagaggagctgtgcgccaagaggagggtttttcttttccgagaatccagaggcccttattatctgcttcctttgtcagctgaacccttgcccccggagcccccagcagtgccctctgaggtggagctgcagcacctgaggaaggaactagagagagtggcaggagagctccaggcccaggtcaaaaacaatcagcgcataagtctcctgaaccagcgacaagaagagaggattcgggagcaggaagagaggcttcggaagcaggaggagaggattcaggagcagcacaagagccttcagcagctggccaagccacagagcgtcttcaaggagccggtgcgttgcccaaactggggagcttgccctcctccctagacctccgggcctttgtttccccacctctaaaatggggcagtgtagccctcacatgaaatgttacttctaaaggcacctgtgagccaggtggctgtgggagagagggggtgatttttctaacctgcctccagccttcccagtgccatgggaggcagacaccaagttctggggtctccagctgcagtgggtggctgctgattgcttctctctgtccagaacaatgagaacaagaacgcactgcagttggagcagcaagtaaaggagctacaggagaagcttggcgaggtgaaggagacggaaacctccaccccatccaagaagggctgggaggcgggcagcagcctcttgggaggggaggtgccaggccagaggcagcttccagcctgggggctggtgaccacagcaccccccagggcagtcctgtgactgtttcttgcttcctgcctctgacttttaaaggtgggtagccctgggctcctctaaggtctggacatcatcatcccagctagaggcatggagcccccaatcacaggggaagagacagtgctataacaggctccttataccaggtgcagtggctcatgcctataatcccagcactttgggaggctgaggcaggagaatcacttgaggtcgggagtttgagatcagcctggccaatgtggtaaaacctcatctctactaaaattacaaaaaaaaaaaaaaaaaaaaattagcaggacattgtggcgcatgcctgtaattccacctactcgggaggctgaggcacgagaattgcttcaacccaggaggtggaggttgcagtgagctgagattgcaccactgcactccagcctgggccacagagtgacactcttgtctgaaaacaaaacaaaaagactccttagattgaaactggattccagcctcggttccactggtcaccattcaagtactttgcatctctaagtctctgtttctttaacttcaaagggaagttagcattttccttacagaggtgctgaggattaaatgagaagagggtatgagatttgaggctggggaaggaggcatggggttctaggaaagggaggcagtcacttaggcctggagtaaggggacaggggcctgggcagctgacagagccccacagtgccctcgctaccctattaatgggcccagaatctggaaaccagccaccacgtgccctcacacccagggtcttcctgcaggtggagctgaagagccaagaggctcagagtctgcagcagcagccagaccattacctgggtcacctgcagcagtacgtggccacctatcagcagcaggtggccgcctatcagcagctgacctgtgagaaggaggcgctgtacaggcagtgactgcagcagacccagctaatgaaccagctgcagcagcaggaagcttggggcaaagcggtggctgagatggcctgccaaaagttgcaggagacccaggggagggagctgccgaggatggggctgtgagggggatgacctggcaaactccaccccttctcactctgtcctggccccttaggagcacctggaagctgccagccagcagaaccagcagctaacggcccagctgagcctcatggctctccctggggaaggtacgggagactgctcagaggaagaggagagagccccaggaggaaggggggactgctagcagcataggattgaggagttggaagagacctttagaacagctggtcattatgccgaccgggtgcctgcactaagttcggcatcagtgtggtgacctcctgtgagcggggggtcaccaagttgcctaaggatggctgaactggccaaggtcagaaagggagcaggtcagaactcccacatcgaccagtagtgggagtgtgcctgggcggaatagcaagatcttgattcttaaaagtaaaaataaagaacaacagctcattcctctctggggaggggcaggctcagggttacacagtgagggtggaggtagaggtgggcccacagtacctcccttgttgggttgtctgaagacccgtctgaccaccccccacaggacacggaggagaacatctggacagtgagggggaggaggcacctcggcccatgccgagtgtcccagaggacccggagagcagggaggccatggtgagcctgactccccctgcacccattttgccacctttctctgtggtccctccaagacccctttatgctcttcgtttccctgccttctgatttctctggaccctcaccccttccgagagccagtggtcagacaccatttcacctgtggccaacaggtgcactctctgaggccccaagggaaggggttgcgctccacctctctgccccatttcttctgtgtatgcccctagaagaatgctcacatcttgccctcaggtggcatttttcaagtccgctggagctagtgcccaggagaagcaggcacagttacaagagcaggtgaaagagcagagggtgtcctgccagcgcctggctcacccggtggcctcggcccagaaggagccagaggcagccagaggccctggagccccagggcctgggggcgagtctgtgagtggggagacccactgggccctgcaggaagtcacggagaagctggcccatgccaggactcacctccaccttctccatgacttgaaaatgccacctgagggcaggtcgctgccgagatgtgactgcaatattttggctccagagcagctttatggaccacctggaggagaaggcagacctgagtgagctggtgaagaaaaaagaactctgcttcatccaccactggcgagagagatgccatcagtgagtgggaggccagggcacggcagggggagctacagggccgtcggaggggccccagcgtctgagccctgtcctcccgcaggaaaacccatcaccttttatcagaaccagggggccgtgccaaagatgcggcactgggaggaggacaccatcaggctggagctcagggaggagatgaaggtagggtgtgcaacatttctgtgggggtgggggtgggggtgggtgtgagggtgggcgcaggcagcggcatggcagctgagcacccctccctccaggtgaagctgctggagctgcagcagatggtattgcggcttacagcaactacaacaatgggcacagaaaattcctggccgctgcccacaactctgctgatgagcccggtccaggagccccagccccccaggagcttggggctgcagacaagcatggtcgtgagtagagccctcaggtggggtgggcaggcaggaagagggggctcccactgtgctcagatccctgcctccctctctccaaagatctttgtgaggtgagcctcacctcctctgcccaaggagaggccagggaggatcctctccttgacaagcctactgcacagccgatcgtgcaggaccaccaggagcacccaggcttgggcagcaactgctgtgtgccattcttgtgctgggcttggctgccaagaagaaggagataaacatcaccatcctcaaagagctgctcaagaaatttttaaataagaaaccaagttatggggttaatctcctacacaattcatttacttcctttgaatgttagagtcactcatgattatttgtttttctaatttatagttttaagtttatttgtaaaaagttaaaagagagtgggtgtctgtggctctcactgatgttcactctggcatcctttagcatttttcttttttaatttcataattgtaggtcattagcgtgcatatcgagtttgcccttacgtggtgggagttcaaacacacaaagacccactctttgcccaaaactgttctctttggtttggaataggctgccatgcttttttaatgttattgcagcatgtatattcactacagaattcagacaaaatttgcctatgttctgctgttgtttgatctaatcttaatcacagtgagctcttcattagctcaatatgtagtttgcccccaagtgtgcactgtttattactttgtaatatgccactatgagtactgacatttagagttgtttaaaggccaagaactggaaacagcctttcctccattttctgtgtgttggtgatgggagtgataaccttttgggggagctttttaaatctcacagaagaggaaagtggcctcctctggcaggtacgtgcaggatagagtgtgtttcatctgttccggtgcccggaattagcagtgtattatggtggttcccttaggatttgtatgtgctctgggctcatgaagatactgcatcatgagctgcagcagttgtactctttttcgatgacctaaaaagggcttatttctgaggaatgaaaggttcccatcattgactgtggatgtgggaaacctttcctagcttagagcatttgtatctacaatacattttaaagtcagagttcatgttacctgttttaatcacatgactacatgtcccagtacacaaaagggcactggttggcattcttcttaatgtatttagtgaagatcataagaaatcctttatgagttcaaacgttcctggaacaggcatacaggctctagtcaagaatgaattagagtgaaggaaagctgtgtgacacctggcattcctctctgttcacggagattctttgaggcttgaagattgattttaccatctagacctctttggctaatacctattcttcaaccaccttggttactctgacataggaatttacttctttttctttgaatggaaaacactttaaaaaataatagaaacattattataaactaatatatgtgagatacttagttgaaacaaaaaggagttttagtagacggtattgtactctctttgaaaatcaaggagaagtttatgaaacttaaaatgtgtacaaactgcagtgcaatctactgttcgtgaatgtcaatgtattatcaggaaacgtgtctatacaatcacagagttatattttctcacagacttctttacaaagtgaaatatgtttttgtacctctgggtttctgttcgggacatattttgtgcaatatttatgtgattgtgcctatgcatgatgaatgaatacatttcagttatatattgcctaaatcataacttgatgatgcttgggaaagactcaacagttaaaacttcatgaagttctaatgtctgtgttccaaaacacatcacattgttaggatgcagggagataggtgtgtgtgctccctgcggtggggatttctagttactagatcatctccatttttagcatttggcatcctcatgatacttctataaatatgacattaacaggagagcaacaatacgattttaccgatggaataacagatttgctggcattcactgaaagagtgcaaatattcggtccttgtgacttccactgactcttccaaattttatgaatgtatcaatgtattagataaacccagtttcagaatgataaagaaaaaatttagaccaaataatgcagctaattaacagtggtacgatttgtagcccgtgggtttaaaatgcacttaaagtcctgttctcgccttttattttctgaacttgccgcttttgcattctttgagttcagtttaaagacagttactttaagagcattttaaaccctcgggctagaaatcggaccactgttaatcagccacattatttggtctaacgttttttcttttatcattctgaaactgggtttatctaatacattgataaattattgcaaaggtacttttatcgttgaaatcacttcacttttaccctgataaatatcagtgactaggaatgaccttcggatagcgtttagcatctgtaaccaatctgacaataatgtgttcatgaggtgcctatggattaaatcacacactggcatatttaagctgaaggtcagtctggaaaataaatttactatattgactgaaataccactctttgtgtaggtatttgtcatatatttaagaaaaagttaaaaagaatggaaattgtatgacaataactcaagtctttctccaaagtgcatgcagtcttttgcgatacctcattcagccgagtatttgtgctcttcctcattcagtataaggcagctttcagtttgcttagaaggcaacattggaatgttagagttcatcagaaacatagaattttaaactgtgagttccactgaatacattttaatgtctgtaggaagaatcaaaacacctatttaaagatggcaatatataataatcattttaaaagtatttgattcaacctgataattttccagaaatgaaaaaaaaaaatcagctctaaaaccaaagctgattttagaaaatttgaaaatgtaaatcagccctatccataatatagtttctctaaaactttattttaaagagtcattttaaaataatataactattaaaaaatgtaactgctatcttaatgttctgaaataatttaaaacattttaaaatatgaatactgtagtataaaagaaagaaatggtgggaacgaaaagcagagaaagaaatgccaattccagtccaaagttttatttgccaagttttcttagaatgaattttaccagtttatgaattattgtaaagagaatgtgtcgtggaaatactgaaagatttttccctagagtggccttattgactgctggtgtgatgccactgtaatgtaataaattattaagttgtttcaatgtgttgtttttgtcttaaaattttattttgcgtttcttgaaaactatagtattaaaggtattgatactgtgcaaatgctgggcatgcttggcatgagataatgtgtttcatttttacaaagttgtaatataactatgcaagtgtttcttaaaagaacacaagattttaaaagttatgggattaaaaaagttatggggtgaaaaagttatgggataaaaaatgtaaaaacgttgtggcaaaaaaacttgtgggaacaaagtagaaaacagtattatgaaaagttaccaaaaaagttatgaaaaagaagttacgggattcttttttaaaaagtcatggaataaaaataaaaattaaaagcaggcccctgtcagcaaagcctggagaagtggggctggggtctccaccgccaccatgtccctaccaccccttcccaggcacccctttacaattagggtagcaggacaagacctctgtctaatggggaaagacaaacagaccctttgccaccctgaccagggctgagtccctaaatttctggatgatgatgattgttatttaagagccagaggctggtggagttggtttgtttggaggaggcctgatgtcccccttactctcaccatagcaacttttccctcaggggggctcccttcttattcagagaggcaggacagtggggctaactgtggaccaggcgagggcacgggctgctggggtggcccccgttccccggtgtacacattgtgtctgtgtaaggttttgtatattccagagggtagggccacccctgtgtcatacctagctgaggttggagccggcacatggggaggaggttgtaataattatttgtggctgggaaacttatttattgctagcataggacagaggaaggaggcggggatggggtcatggctccctggtgatgcgactcctgtttattttgctttttattttggaataaatggatttagccatactgctcggcctggtgtgtttccgtttccctcactgggtcctggagtttgtgccaccaaacaaggagtcccagagtgtcttgagcatgtccagctaggctgttggggaccttccaggcgtgttacctgtatgctgcctggtggcgcctgggggattccaaggggactgccatgtagtctatggggcgcagtctggccctgacagccaacaggctcagaagcctgatctagcggtggccgggaagacaggtaccagcacctaagggcactgacttccacccagccccggcatcttccgttctatccccttgtctccctctcctgtctgcacctggtggcctgttctgtctgtgcctccagagtgccggctgccctgcaggctccctctgggctgagttcatggccctgccccctggtggccagagccggcttcacaggataagagcccgctaagctccaggggctttccaggaaaagtgtcccttggaaagggcatggccttttcactgctcccaacagcaccctagaaatggcttggcctttcccctcccctgagctccacagagaacacagccagcagaggacacacttccccgccatccagaagcgggtttgattctcagccaagggacagcaggactggtagagactgtcaggccacacagctgcctgcacagcactcccatgcttggtggggggggggggggcgggagggatggcggggtgtgtctctccataggctgggcgtgacagggaggctcactgaaggtagcgcactttggaggggcaatgtcaggggttagctttctcttgtttggccacaagactccaaaaggacagcacggtgactgattcccagcgctagaggcgaggcggttggccacatgtaggtgtgtgtgtgtgtgtgtgtgtgtgtgtgtgtgtgtgtgtatgtatatgggtatttgtagatatttctagaacagggcaggggcataccacagaggggggcacaagttttcagcaacggtcacacctggatgtgtcagctcaccgcaacaatagacgaagtcacagatgaagggggctgcctttggggctgggggagccactgccaagtcacagaacagccgcccaggcaggcttggaaagggaagtctctgagaagaggaggaatctgtttagaggtcaaaggggggcctggggctctcaggatgggatggacttgcctgagccgattggctggcagttggagagaaagcagagagaagacaggagagagaaaagcgagcatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatgtacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgcagggacatggatgaaattggaaatcatcattctcagttaactatcgcaagaacaaaaaaccaaacaccgcatattctcactcataggtgggaattgaacaatgagaacacatggacacaggaaggggaacatcacactctggggactgttgtggggtggggggaggggggagggatagcattgggagatatacccaatgctagatgacgatttagtgggtgcagcgcaccagcatggcacatgtatacatatgtaactaacctgcacattgtcacatgtaccctaaaacttaaagtataataataataataaaaaaaaagcgagcagagagctggtgaggcaagtgcagagcacaggtgtgccacagcagctgtgggagggccaaggagtaaagggtgcacgtgcgggtgtggcaaggttcctggaaaagaggggctggaagggaaaggggaggaagacagagggaggagccggagtttcacaggtagtgcctgggggctgtggcagccctccccaccccacacgtgctggcctcttccacggcacccagtgcacccactgttaagactgatgctcagcccctttgggcttccctcttctctgggcaccgtgtcttccaacccacttgtccagggccacctctcgccttggggagcccaaaacaacagccaccaggcctgatagagaagaaacactgcttgaaccaggatgatgaagctaaaagggatggatgggtggagtgatcgccggagccccctctggggggtcagaaagcccaggaacccttgaagggtccctgggggaggaaaggagggcatgcagctggatgccactggctatagacttataagtctaagaggggagcctcagcttgttgggggttgcaggtcggataggtgaggctgggcccttcctgctgggaaaagcagaagagggagagtctatggcaggggaggtgggtgggcttgtggggcggaggtcagctgggccagcaggcactgtggtccccttggctgaatagcagaggtgacctctaggagcaacactccaaggtgcgtgagcctgctggccagcaatagtgcttcagcgggggccagggaccctgccttcagtcacacgctagcagctatgatggtacctgggagggagggaaggggcctgtgtttcctgcctggcctgtgaggtgtgttgtgggttgaccgtgtgtatgggactctcaaggttttatcctatctcaccactgcattgccgacagatagaggaggtgggactctgactatcacccctgctctgcagtggatttggctctcagcactcccaggctgggagctggatgccctgccctggcagcatgactcagactgcccaacaggtgcggtgtgcacaggaggactatcctaggactctggccgcctcagagtacagccccacacaccaccccctctaagctctcagcccttacaccataaaccacgagctctgtgacggctccagggagcacccatgtctaccagcgtgggcacggagcctgttccaagagtccccaggctcagccatgggggctggggggctttggggccgtgggagccagccttggtacctgcatccggcaaggacgctctgcacctgcaggcaggagttgtccacgggcccccatgtgcgtgctgatggtggtcgtgttgatgtcgccgatgatgccgagtgcctccttcagcacgtggtacatgcgcagcatctcgtcgcgccactgtgcctgctctgccgactcttccatcagcgttttctggtccccacgtgagtacaggttggacagcagctccgagaagatgaactccttggtctgagagcgggcaaagagggaaggaggttgggacctgatgcctttgctgccctggcctcctgccgggccctgctgggactgtgtgctggacttggagccctgagtatggcttttcagacgcggcttctacaccgcttagactcaaagatctgcctccccaccgcccttttctcactcagatagggacactgaggtccaaaggaaaagtcacctgtccaaggtcacacatctgggaggggacccaggacctatcatgccaccaggacaccggtctactcagtttcttaaaaatgttttttggagataggatcttgctctgtcgctaggctggaggacagtgggcgagatcaccactcactgtagcctcaacttcttgggctcaaagtgatcctccaatgtcagcctgtcgagtagctaggactataggtacgtgccaccaccaagcccagctatttttaaaattttagtgtagagatcaggtctcactatgttgcccaagctggtctcgaactcctgggctcaagctatcctcttgccttggcctcccaaagtgctgggattacagacatgggccactgtccccagtcccacgttatatttctatgagacagctctggtctggactgtgcctccctccctggaccttggtcccatagggctggtcagcatctcccccaggccaacatggccacctgcatccccagtgctacaggagccccctgcccctatgaggcggtgcatgcacgttgttgatcatgacgtgcatgatggtcttgggcatgacaccaaccatgaggtcccacacggtcttgttgacaatggccatgtaggagtccacaaggttctgggtggtttccatttgccgctccagctatgggtccatggagtgcatgaagctgtcggagccattctcctcagccttgctgtcctgtcatggagaacacagtggcatcagggtggccaggccatgcagccaggctccaggaatccctaggatctcagcacctccaagggtacctggaacattgaggcacagagaaaaacaactggcgtgaacatgcaccgagctccccacacgctctagacggtttcaggtatctgcctctcaggaccccagactcccctgattcagtctcctcttagttctgactctagtgcccagaatctgcctcaagttaccaatccagaaactggaaaaaaacatctccaggtcccctgttggagacctggccagagcttgtgccaggctgcagacgcctggcagggggcaagaaaggggcatactcactttccccttgtcctgggaggcccatgcaccaacactgccaccgccgccgccaccagggaacacggcaaagtagacacacacagagaggaaaacgggaagggttgagtgaacctgggacactgcaccccaactttaatgtgttgtggaattcagttagctaatattttattgaggatttttgcatcaatattcatcagtgatattggcctgtagttttcttttttggtctgtgtgtttgattttgttatcagggtaatgctagccctgtagaatgagtttgcaagtattccctccttctctatttttggaatcgtttgggtaaggttggtattagttcttctttaaatgtttgctagaattcagcagtgaatcatcaggtcccaggcttttctttgctgggagactttttattaccactttgatcccattatttgttattggtttgttcaggttttgggtttcatcatggttcaatcttggtaggttagatgtgtctggaaatttatccatttttggtaggttttcctatttatttgcacacagttgctgaccactagtgatcctttgaggttttttttcttttctttttttatatggagtcttggtctgtcgcccaggctggagtgcagtggcgcgctctcagctcactgcaagctctgcctcccggtttcacgccattctcctccctcagcctcccaagtagctgggactacaggcgtccgccaccacgccctgctaattttttgtattttttccgtagagacggggttttaccgtgttagccaggatagtcttatctcctgacctcctgatccacccgccttagcctcccaaagtggtgggattacaggcgtgagccacgcccccttgggacagggacacacacacacacacatagacacacacacacacacacacacacacacacacacacacacagagttggttgttgtgccgtccagtcgcgagtgtgaggaagggaccagatcggtcgggcagaaaggtgctgggtcaagagaggagggggcagccggtagcgcgggcacgccgggtgcgcgcggggcgcgccgggttgaggggtgaggggtgaggggtaagaggtgaggggcgacgaggaccggggcggggtaggggcagccctttcccaggcggtagcgggggcagtggtgctgttgcccttttaaactgcggcttgacgggagccgcgcctcctgtcggtggagtcggttataaagggagcagccccgcaggccgccacatagctcccgccaagtcctcggtgccccttgccattttccagccgcgctcccacgagggtcacggcggcggggagaggtggagccgcgagagctcggccgggggccccgcctggtggtcgcggccatgacagcggctcgggactggctccttttccgcgcccctcccgccggaggtgaggggaagatgtccatgtccgggttcaagggcaaaccgaagttactggcctctatcttccaggagaaccaggagccacagccgcggctcacgccccaccgcaacattaaggtgagtcgccgggtggcggcctggcggggcagggcgagggcggaaagcgggtgcccagagtcccaggagaaaggggaagctgccccagagaggccgcggttccccgcccctttctcccgcaactggcccgcccggcaaggcagaggcttgggtgggagaaggcggagggcgcgtctctccaactcctagcgcggggctggcttgggggctgctggcccctctcggcccctgtcgctgcgcctcgaggtgggagcccgcggctgcgggagctctcttgggacccatggtcgccctcagtcagcccacctgctctagggaccgcgacagggcggggcagggcggctcccgcgttgttggagcccaggcggggaaggggaaaggcctttaagattttcggttttttggccgggcgtagtggctcacgcctgtaatcccagcattttgggaggccaaccgggctgatcacttgaggtcatgagttggagaccagcctggccaacatggtgaaacccatctctactaaaaaatagaaaaattagccggtcgtgttggcaggcgacttaatcccagctatttgggaggcagaggcaggagaatcgtttgaacccgggaggcggaggttacagtgagctgagatcgagccattgcactcaaacctgggggagaagagcgagacttctctctctctctctctcaaaaaaaagttttctttctttttttctttttgttgagacagagtctcactcactctgtcgcccaggctggagtgcagtggcgcgatctcggcttactgcagcctacctctcttgacagtccactggttaaagcgattctcctgcgtcagcctcccgagtagctgagattacaggcgcccgccaccacgcctggctaacttttgtgtttttagtagagacggattttttagtagagacgcggtttcaccatgttagccagcatggtcttgatctcctgacctcatgatccacccgcctcagcctcccaaagtgctgggattacaggcgtcagccaccgcgcccgccctctgttttgttttatacatgtaatatattcacaagtatctttacgaagtgattttgatactcttttgtcttctccctagaatctctttgttctgtaataattttttcttagtttatattgatcttattttcctttttaaagcctttccttacatatctattctatgttgcttatcatttgtagtttttttattttttatttatttatttatttatttatttatttatttattttttattttttttttttgagagggagtctcgctctgttacccaggctggagtgcagtggtgcaatctgggctcactgcaagctccgcctcccaggttcacgccattctcctgcctcagcctcctgagtagctgggactacaggcgccagccaccacgccccaacaattttttgtattttttagtagagacggggtttcaccgtgttagccaggatggtctcgatctcctgacctcatgatctggccaccttggcctcccaaagtgctgggattacaggcgtgagccaccgtgcccagccctgattctatattatagtgagttgtacaattatttcattatatgttacaatgtaataataatagaaataaaatgcacaataaatgtaatgtccttgaatcatcccaaaatcatctcccccaaccttgtctgtggaaaaattgtcttctgcaaaactggctcctgatgccaaaaagtttggggactgctggcataagtggtctcatatagtagttgtccttttgtgcctggcttatttcacttagcataatgtctttaacgttcatccatgttgtagcatgtgccagaatttcatttgtttttaaggctgaataatattcccttgtatgtatttaatatgcctttttatcttttcctctgttgatgaatacttgggttgcatccacctattggctattgtgaatagttttgcattgcctgtctttctcatgatcgccatcctatttcgcatctagcaggtgtgaaattccattgattgagtgattgattgagacagggtctgactctgtcgcccagtctggagtgcagtggcatgatcttggctcactgcaacctccatctcccaggctcaagcaattcttctgcctcagccttccgagtagctgggattataggcatgcaccactaccagctggctaatttttgtatttttagtagagacagggtttcaccatgttggccaggctggtctcgaactcctgacctgaaatgatccacctgtctccgcctcccaaagtatttggattacatgtgtgagccactgcgcccagctagtaggtgtgaatttctatgtcttagtggttttgatttgcatttacctgatggcaaatgatgttgagtatcttttcatgtgtttattggccatttgtctgtttttttggggaaatacttattccaaaatttaacttatttttaattgggttatgtatctctttattatttagctgtaagaattttttacatattctagataggagttataacaactttcttcctttttctggattgtcttttttctttcttgatggtgtcctttgaagcagaaagattttaaattttgatatagtccaatttatcttttttcatttgtgtttttttgctccttgtgcttttggtgtaatatctaaaaaaacgttgctactccaaggtcacaaaggtttctgcctatgtttttttctatgagttttatagtttatcaatatctcttatattgagctcttttatccatttgaattaatttttgcatgcggcatgaagtaggggggtatagcttcattgttttgcacctagacatccagttatctcagaactatctgttgaaaagcttattctttccccattgaattgtcttggaacgcttattgaagatcaattgactgtatatgtgaaagtttatttctggattctattcttttctctgttcatctgtccttataccagtagcacactcttgattactgtagctgtttagtaagctttgaaatcagaaagtatgaatcctccagaaagttttttaaggtgggtttggctgttccgggtcacttgcatttccatatgaattttaagatcagcttgtcagtttctgcaaaggagccagctgggattttaatcacagtcgcattgaatatgtagatcaacttagaaagtactgccattttaacaatattaagttttcctccatgaacacaggatgtatttgtactaatttaggtcttcctttaatttctttcaatcgtagttgtgttgaatgcagacctactttgaattaattctaagtaatttttatgctacttattggttgacaaatataattgcttttagtttttaactgtagttttgatgtaatgtgaactgtatttggaccttgtgaagcttatttctgctttgaaatttagtataaattggttataataaaatctgactgtgctaattttttggttatgtgaaatagaaaatcaatgtaaatttaaaaatttattctgggccgggcgcagtggctcacacctgtaatccaagcactgtgggaggctgaggagggcagatcacaaggtcaggagatcaagaccatcctggctaacacagtgaaagcccatctgtactaaaaatacaaaaaattagccgggtgtggtggtgggcacctgtagtcccagctacttgagaggctgaggcaggagaatggtgtgaacctgggaggcggaggttgcggtgagctgagatcgcaccactgcactccagcctgggcgacagagttagactccgtctcaaaaaaaaaaaaaaaaaaaaaaaaattcattctgaaatgcgatagatgttgaagctcttctggcagatggttataaagaggaatatataatcattctattgagaaaatataatcaataatgtgaatacctaaggtagtttattttacatatatatctcggtatttatttatttttgagacagagcctcactcctgtcacccagggtggagtggagtggcacgatcatggctcattgcagcctcaacttcttgggcttaggtgcttatctcatctcatcgcagccacctgagtagctgcgactacaggtgtgcgccaccatgcatggctaattttttgtatttttagtagaggtttccccatgttgtccaggctggtctgaaactcctggactcaagtgatctgcccgcctcggcctcccaaagagctgggattacaggtgtgagccactgtgttggccttatgttttataatttttaaatgatactttttattctattacaaaacatatataattgtaaaaaacttgtaaaatataaaagaggacaaagacagtagaaaaattatttacaatgtaattcccaagtaaacactgattacctttttttttttttttagagcctgttgctcaggctggagtgcagtggcaccatcatagttcactgtaacctcatacatctcatacattttgatattactacttctggttttatacataatgtgttcactttgaagcaagagagtataattttataacgattattttcatttaatgatcgtgatctcattgcaattattgatcatttagtttattcctgaacattttgttttatatatttttgctattgtgagtgggatatttgttataacttggcatttgtgcctacactcaatttacctataggaaactaatttttgcatacaattgttttaattggtgcagtggcacaatctcaactcactgcaacctccgcctcccaggttcaggtgattctcctgcctcagcctcctgagtagctgggattacaggcacatgccaccacacccagctaatttttgtatttttagtagagacagtgtttcaccatgttggtcaggctggtcttgaactcctgacctcgtgatccacccgccttggcctcccaaattgctgggattacaggcttgagccaccgtgcccggcctcggcctctttgtgtgttttcgtatatctttcatctgagttgcaaggggcaccttgggtttccaggaattttcttagctaactctgttcctttatctatgacccttcctcactagttttggataatttattttccttcttccttacttcactgatttacttttctattttatttagtttgctagtcattgtttcttttaaggttcttaagcataaatccttttttttttctgatgggaaatactggggcatagcactaggaatacaaattatgtttaaatagagcacaaagaaccatctcaaaggaataactgatggtgaatgtctggtgattgattttattatgtatcatctctaatgaggcttaataaataattgaggtttaacacttaggtaaccggtctgtatttaagtctgaaaatttttgtatgttacagtttcaacttcacattgaatattctgtaaagcagaaataaattgatcagcattctatgaatgaaaaataaagccatgggtcgggtgcagtggctcacacctataatcccagcactttgggaggccgaggcaggtggatcacctgaggccaggagttcgagaccagcctggccaacatggtgaaaccttgtcctagctactggagaggctgaggcaggagaatgactttaacccaggagacagaggttgtggtgagctgagatcgcgccactgcactctagcctggtgacagagcaagactctgtctcaaaaaaaaaaaaaaaaaaattagctgggcatggtggtgcacacccgtaattccactacttgggaggctgaggcaggagaatcacttgaacccaggaggcagaggttgcagtgagccagggttgcaccactgccctccagcctatgtgacagactgagactccatccctaaaaaaaaaaaaaaaaacaaaaaaaaaccatgctggtaatcgaaaaagcagtttgcctcatcagagtttagaacgttgaattgtaaagatcttttttgtagtcctagccagttttaatggtaacatgagcaattcagttactttctcagagttttatatttttatctgtaaaatggaaattatggtacctacagtttaggatttttgtgaaaatcaagtgagactgcaagtgtcttgaatagcagtggaagtacattgatataggtgatattttacagtggtgtcttcctcagcatcatattagttcagtgttttaaagctctatattagtcacagaaacaaagtcaaatttttgttctcatttcagattacaagtggacacctgagtcagcaggacctggaatcccagatgagagagcttatctacacgactcagatcttgttgtcacccccattattgacaatccaaaggtgcagaaagcactctgacaagtgagttgtagactttactgagatctgaaatctgcataagattttcattcagaatattatttactgtctaatctttcctgtttctcttgtccgctactctttcatttgtgctgcatgtctgcatttccagctcccgctctgtctgcaaccctttcctctgccttcacttccgcttcactggagttctaagttttcccccctctgttttgaatgagtcagctctgcttctcactactgctttcttccacatgccacggaggggttgccagcctcttgacctcagaccttagctctcagtcccatcgtttctccatctgcactaatgtgaatcactctaagtattctagtctctgatgtgttttgaaggcagaagcagtcagagggcactgctcaccaggctgggctgggcaggcagatcacacggaagccctgccctgtcacaggttgttaatactgcaggggagatggtggggagacactatgggaacttgaggagtcatggttcacaatgtacttctaaaccactgtgagtttttttgcttcttgtcttttggaatataatactttattgctgggggataatgagtatttactttaaaaaacagatgcatttctaagtccctctgttttgtcttgacttccagctccccaacatactcacattccactacttattctctattttaactttactgcttcttttacttttttttagttttacttttattttttatttttttgagacagagtcttgctctgtcacacaggctggagtgcaatgacgcgattttggctcactgcaagctccgcctcccaggttcatgtcattctcctgcctcagcctcccaagtagctgggactacaggtgcccgccaccacgccctgctaattttttgtatttttagtagagacagggtttcaccatgtaagccaggatggtctcgatctcctgaccttgtgatccacccacctcggcctctcaaagtgctgggattacaggcatgagccaccacacctggccttctttttcttttttaaatatctttttctgtattaattcatgactgtttttttcttgtctcattgggaacattagtgtggtttagaacaatgtaagggtttttggattcatgtttattttctagatagacagcattttatatagatgatttagctgtttttcataatggagctaattctttttgtgagttcatatgtctggcagtgtaactttattatgctaagtttgatgtgcattggcgcattttcaaaatgggctttctagaacaatttgtgatatctttcccaggggtgtccagtcttttggcttccctgggccacactggaagaagaattgtcttgggccacacataaaatacactaacaatagctgatgaactaaaaaaccaataaaaaaaaattgcaaaaaaattcttacgatgttttaagagagtttatgaatttgtgttgggccatattcaaagccgtcttgggccgcatccagcccacgggctgcgggttggacaagcttgctttacacaatattctgtgtttccttttttcctcttataaccatatttgatagtttatgggaagccttcatcagtggaaatttttgtgtttaacttttaattctaaactacttttagagaaaagattaaaaaatagttgagaactcctgtatagcttttgcccagctgctcttaatgttcacatcttataggtctatagtatagttagcaaaacctgggaattaacattggtatagtgttagtcaggcgggataatccttacctgtgcctccttttggagggcagcagaatgtggtagttggaattgcatgatacttgattcatatctctgtgtaatgatggcatgcaataccctgactgctcctttcgaattcttcctgaaaagggaaaaataaaacatgagaatagtgctgctaactaccaaatgcatttgaattttaccggttgcctctaatgtcctctttttttttgttccaggatcccacattacagttagttgttatgccttcttagtctcatatagtctgtcctagtttttcacggttttgtcagaatttctcagactttgcttgtctttcatgaccttgacagtttgtcttttattttgttttgttttgttttttgtcacccaggctggagtgtagtggcgcgatctcagctcactgcaacctctgccgaccgggttcaagctattctcctgcctcagcctcatgagtagctaggattacaggcacctgccactgcacctggctaagttttgtagttttagtagagatggggttttaccatgttggccaggctggtcttgaactcctgacctcatgatccacctgcctaggcctcccaaagtgctgggattacaggcgtgagccacggcacctggcctttgtatgtttttgtaatacatgttataaaacgtatgactcaagtccttgacactttgaagagtaactggttgggtgttttgaagaatgtcccttaatttaggtttgtctaagggtttctcatgactcgaatgagattatgaatttggattatgagattagaatgagaatatgcattttagtaagaatactacagtaaatacagtaatgctggttacttaattagtaaaggttttaaaaatattacatatagaagttttgcagaagttaggtatagaaatgatggttgaatttttaattaaaagtctcaagatgcagtatctggctgtcctaagctcatggatccaactacatggtttcttcacatttctcaaataaattatgcactttccaattcatgctattatggcttccttgaatggtgtcttctctgatataatcataaagttctagccatccttcaagaccgcaacccaccttctacgtcttccgtaaacccggtgtcaagtatatcaagtaaagtgcttgctgtattctctaaactactatttacaaaaaaaattctttctgtccagggttttgtctgtagttatgtcctgcctcttttgaattgtgaaatattttcttgtttatcaaatgtttgtctcatcttcccaaccagaaagtcagctcgctgaaaataggattgtgtcttttatatctttgtatcccccttagcacttgacatagagccttaccttggcaggtaagcaatagatatttgttgaaagactgaatttctaattagacgtaaattacctaaaaagtaagccaggatggggtgaattttttctttgaagctttattttattacagatatcaattgaaatgattttaaaaaataaattattatctatatatgtatgttttaatctgaaaaggcatcgttctttttgtttttggtaacaaattttacacattctttttttgtcctcattgatttattatctgatataagggacatataaggagacagatatccatctttaaaattgcctcaaaagttttttttttttttaaccacagataaggaaacaaccaccatcggttaaatttgatgcaaaaatattgcatctaccagcattttcaggtaggatcataaaggacttatcgaacatgtagactgtctgtatacagatacgaatatgaaatttattcacaaatggaatatttgtatgtgaacaactaaatttattttgtcttgacaattggttatattcttgggtcagtgttatgtgaattgtaaataatctgtaattcatttgtgccagctgttgacatttctcagctgagtctgggctgccctgtcctcttgtgagtggggaggttcctgtagatctgggcaagttttcctgtagagtgggtggggggcctcctcccttccgttcatagagctggttgaatttccaccatttatggcaggtgtaggtgcacagggttggggacaacaaggaaggattgggattctattggcgggaccaggacatttgagaacgggactaggtggttcatgactgtggagatggtgtgggagtggagatacttaagggataattattacatttctgttgagctaatgaaaatcttatttacggtgaaagtcagaaatttttacataccttaaacttttttttttttaacaaattatattttaagctgttaaactcaatttggggaaaattattcattgtggctagagtagaatctatgatttgaagtaaatttaaaatatatttaggtttaaataaaccagctaagggtttatatcagtcaacttaattagtgataaaaacaaccaaaaaaacctgtgtagaaggacgtttttgaaagaccaaagtgaagcaaaatattaatagtgctttcagtgccaagtaggtctatttatgcaaacctagagaattattatcgggaaatactatttcctttttcttctttgagttacttaggaaattatatttacaatttctttgtctaaagattgagatcagcaaaaacatgttagcaaaaaattttagggagtatcacatttcctagattttgccctttttttatagggatttggaggtaggaatttcaggtgattttagctatcatgttatcctcgttatttttttacagtaatttcattggaactttttaataactgtgtggtttgtgcttttctcaatatctgagagttgatttatttatacaaaggcttttttgtcttttactccagttgtattgaactttgcattttgttataatctaggttgtgagacaattctgctttagacatctgcttggtttgaaagcatagttttccattgaagtgtttaaaaagtttccatggatagataaagagatgaggaatatagaaggacaaatagaagtagtgtcatctttggagtatttttggtgttgacagagtaatgttttctttgtcctcatcttagctgtcgtaactctgtgtttatttctcatgtaatgtttccagcagttgtttttctcatcatcatacttttgttattttctttccttggcaatggataagttataatttctgaaagaccaagattggaatgactttttgtaacaagtgtgctcgcagatcgactccagtgagaagagctcggggacctcctgagccaagcttaatctcctttgctgtttgtgagtggtggctggtcaccaggaggtggccaccaggctcctcctttccccgctggtaggcctctgtgacatgacttatgcatttaaatttatgttttttatagaggctcaaacaagtgctaaaatagcaatttgatttaactaccatgaaaaaactgatttatcacgattttaggtttatgcaaattatcctctgcttaatccttacgtcttaaagtagataagagtagacggtgattttgaactttttgttgttgttgttgtttgtaatactcaggtttccattttatgttaacttgtaagatttttaaaaaatatgtgaaatcaggccgggcgtgatatcataagacagaccttttaccttctcatcagtgactggaatgaacgcctgtaatctcagtactttgggaggccgaggcaggtggatcacctgaggtcagcagtttgaaaccagcctggccaacatggcgaaaccccatctctactaaaaatacaaaattagcagggcgtggtggtgcactcctgtaatcctagctacttgggaggctgagacaggagaatcacttgaacccaggagccagaagtcgcagtgagccgtgatcatgccattgcaccccagcctgggcaaaaagagcgaaaccccatctcaaaaaataaaaacaaaaaacaaacaaaaaaaaatgtgatatcataagacagaccttttcccttctcatcagtgactggaattaactgcccatgtggaacgggttgtgggtgttggttcctttactgggtcatctggtaaactgcaaggtttctgctgtgacattgaaggcagacatcaaccctctaagacatttttttcctatcctctgggaatattactttttggacaatcttggtccattggtaagctcatgggaatttgtcagagtttttttgtttcttttggctcatgtttagcatcgattggcagagtgtttggagtcatcctcagaaaggaattacagtggttcggaggtgttttctgtagtgggccctcatttgggaattggcttgaaaaaaatgtaagttcacttgcttccaggatggtattaagattgctttttttgatagttggcgtgtgtctatcaggtaagggctgtcatttagagaatataaagtggtaggagaaactaaaagtactgttcttagtttttattttaatcttattcgtatacaagtgcctttgtaatttagcaaatatcatttttggtgtacagtataaatttcctttttataaagatctgagtttttaactttgctgtcactttctgtgtttcatgacttaaatattttaattttttctttttttacatttacattttttattctagttccaattgctaatccagcatttgtggatagctgcaaactgcgatatgtaagtaacatttacattttaaaaattatttctcatggttttattaagtagttacagcatacatatttatcaaaagcagagtcctaagtaattatcataaattttcctgatgtaatgatgaatttactcataggcaatttttatgggcattccaattataaactttagaatatttaaaaatagcccttctcctaatatagatacgattctgggattatctaagctactcctggaaactttattaactgttgttgtttttttattttcgtagagacaaggtctctcactatgttgcccaggctggtttccaactcctgggctcaagtgattctcccatctctgactcccaaagtgttaggattacagacgtgagccactgcgccaggctaactgttactgttttgagtattggttataaaatacttcaaccctgatccctgtgtattaatttagttatacttcctcaaagtttcccttgggcacccttatctgtccctatgtagcacatagcttccctatgatgttatttataatctaatgagattaattatgatttataaactcccgatggaaggaagtgtccttactttttatagaagcaacataccaggtggaaagcaccgtagatcaagtgttagaaggctctgggttcctgttgcctataagacttggccaaatgattatctttttctcaatctctgtttcctggggagtgtgggtgggacaaggaaatggcataggtttaggattcagacagacctgggtgtggatcaaagatccgctttctgggccaattactttaattgctgagccgcagtttcctcatctgtaaaattgggatgggataactacttcatagatttttggtaattattcaactttgaatgtggtaaatatgtgagatacctggtatagtgcctgtttctttctttcttttttttttttttctgagtcggcatctccctctgtcacccaggctggagtgcagtggtgcgatctcagctcactgcaagctccgcctcccgggttcacgccgttctcctgcctcagcctccttagtagctgggactacaggcgcccgccaccacgcccgcccggctaatttttttcaccgtggtctcgatctcctgacctcgtgatctgcccacctcagcctcccaaagtgctgggattacaggcatgagccaccgtgactggccgtatagtgcctgattcttagtgggtatttcattgacagtggggttggggttgtagaagttgtagttattatcatgaagcttgcttatctcatgattgttaggacaggcacatgaaaaaacggaggtgaaaggattttgtgaattgtggcagtggtataataattattcttctatgctggtgaaatatgggtgaaacaataggagtttagaaaatgtttaataataagggtaattcttattatacgtcttctaatgttactctcgcaaaataaaatctggtaatagaaagtaggatttttaggtaatggttgagcatttaatactttgagaaggcttatggtatgctcattaaaaatgaatcaatgaaatatgtatctaaacacttttatttaaaacgtgttatatacctgaatggggtgctccctgctgacattttcagacagacattccaaatcatttccgagaacagtcatccctctgtatcagccaggagaatggttctagtatccccttggatactaaaattaacacatactgttttttcccccactgttaaaaattgaggtttgattgtaaaacagttttaatttgaataaaatgatactgaggtagacaagttctctggtaggaatcttcttttattctctttctccatccaaagccacttccagcgaggttttctctgacctcaggttatattaccttgatagcatatgataaagggtccttaacttagtctgggagataattattattgaagtagatacttagttttgttttgcttataaaaaattagaatcacatgatatagttttttatgtttgttttcccccataacatatatattatgtattttaaatgttatcaacattttaaaataaaatacataatacttaaggtaaacgttttatatgttgtgaatatctgatcattttgtttactatttttggatagtattataatgttgtaaacaacattttgatgaacatttttgagattaaatcttcgtgcccgctttttctttttccctttaggaaagattcatagaactagaacaaatgggtagaaggcagtaaatatctttgtgacttctgaaaaattgctgaaatactcttaaaaaaacattgtatcaatagataatcccagtcaatgtgtttaaaatgccttttgttagaacttccaacgttgagtatttatcaaattgtatatccttttatccttgccaatcaactttatgaggtataattcatatatagtaatagtgtaatactgtaactttaaaatgtgttacttgtaaattacacataatttaaaatgttccattttagctatttttatgtgtacagtgacatttagttcattcccattgttgtgtaaccatcaccactattcatttccagaactttttcgtcatcttaaacagaagctctttacccgttaaacataacttcccctttcctttcccttccccagtcctggtaacctatactctacttattctatcttggtaaatttgcttatggtgagtacctcatattgctactgaaacatcgaggggtttggtctaggtcctgttgctcacagcgcagaaagccaatcacggagacgatgagtgttgctagggaacaaggcttcaattgggtgctgcagctaaggagatgggagatcaatctcaaatttgtctcctcgactgactaaaaccacaggtttatttagcagggaagaaatgtaaccatgtatgggaaaacaggagttagggaagggtgagggagaggagttggtcgacaggaagcaggtagttggttaggcaattgtgatgggtgaggtggtctggtgtcttatggtccagatgtggtgatctggtaagtttcagttccttgataactatctgggaggcctgatggttggtttcccaagaaaggaactcagataagacaaatgtaactttctcaagttttaagactgggagggtcaatttctatctttattttaaaagactgtaaacatcagttctataggacaattgggctggtttcatttgcaaggtttatccatgttgtaactaacatgtgtcagcatttcattcctttttaaggctgaataatatccctttgtatgtaatataccacagtttatcttttcatctgttgttgggcactggcttgtttatatcttttggctattgtgaacaatgctgctatgaacattagtgttttcacacctgatgggtatgaagttagtatctcatgggtttgatttgtattttgtgactagtgatgttgaacatctttttttgtgattgttggctatttgtatatcttccttggagaaaggtctagtcaagtcatttgccaatttttttttctttttttgagattgagtctcgctctgtcgcccacgctggagtgcagtggcgtgatctcggctcactgcaacctctgcctcccaggttcaagcgatcattccatctcagcctcccaagtagctgggattacaggcacctgccatcatgcccagcaatttttgtatttttgtagagacgaggtttcaccgtgttggccagatggtcttgaactcctgacctcaggtgatccacccgctttggccccccaaagtgctgggattataggtgtgagccaccgcacccagctggtagattttttgttttgttttgttttcaagaaggcctctcagtggcttacctctgtgccatgctttggagtttgagctgtcttctctttactaactgtagctctgtaggacttgggagtcaaccttaccttcttttttcctccctattttgtaggtcttgtttgagttagcttttctttttattccaggcctgtaaattttactagattgtctctaggaatttcattttactaatttgcttcagcctgcctgcctgccatctctttttactaatttgcttctgcctgcctgcctgcttccttccttccttctttccttccttccttccttaattccttccttccttccttccttcttcccttcctctctctctccctccctcccgtcccttccttcccccctcccgtcccttccttcccttcttttctttccatttattttgagatagagtcttgctctgttgcccaggctggagtgcagtggcgcaatcttggctcactgcaacctccgcctcccgggttcaagcagttctcctgccttagcctcataagtagctgggattacagttgtacgccaccatgcccagcttatttttgtatttttagtttagagatgggttttcaccatgttggccaggctggtctcgaactcctgacctcatgtgatcctcccgccttggcttcccaaagtgctgggattacaggtgtgagccacaatgcccagcctcctcacccctcctttagctattatattacttcctagatttcttcctctctatttcaccctttttctgttcctgaaacccctacaggatgggtgtgggagtttgtgtctcatgactcttctttcaaattttcttttgctttctcactttctcttgtttattgagatataattcacataccataaaattcaccattttaatgtgtacagttcagtaggtgtcagtatattgaaaactgttcaaccattgccactatctaatttgagaacagttttctcacccagtgaaacccagtacccattcttctccaacccctggcaacaactaatctacttcttgtcagctgatttgctattcttgatatttcatataaatggaatcatacagtgtgtggccttttgtgtctagcttctgtcatttagcataatgttttcaaggttcctccgtatggtggaatgtgtgagtacttcattctttttctagctgaataatctttgtatggctattccacattttgcttatgtggtcttgatggacatttggggttgtttccacatttggctattatgaataatggtgctctgaacatttgtccacagggttttgtgtgaacatatacgtttttatttctcctacagtggtgagattgctggataaaatggtaactctgtgttgaaccttttgaagaactgccaaagtctctttgttaaacttttattttaggttcaggggtacacatgcaggtttgttatataggtgaactcatgttatgggggtttgttgtatgaattatttggtcacccaggcactaagcttggtaaggaccaattgttattttttctgatcctctccctcctcccaccctccaccctaaataggcccccgtgtcgattgttccctctttgtgtccatgcaaactttcttcttttattgctcttccttgactttatctttgagctctcaaacttgatatttatccccactcattttattatttaggatttccagttaattttttaatttcaacaatcatatttgaaagtttttgttcattttctttttctctgattggtcctttttcctagctgcctatatttggtatataatatacttttgaatttgaggataaatattaggattataaaaatcctcatcttggagcagaatttagaattaaatattgttattaatatttaaggctaaacattaggattatataatataagcctggaacctggactttgaaaaaaagggaacaaaattaggattatgaacattgtattcttatctcttgaacttgcaggtcacttctttttcatcatggtcctgctttttaatgctgtttatttctcaaatgcctggtgatctctggttcttcatttatattatgaataaatgattaaattgattggtatagaagttggcaatatgagtttcctttattcttgcctaagtctctttctccaatagcttctcctttaaagaaagggctggtatgtgggtaggtgaggcctgttgactggttgactttaatttgggattccagctggctgaagatcagtaggcaggctggaggcctctgcaattgccagggtgggtttttctttgcagtggagctggctttcctcatttattcccttccccgcttcggtatctggaggaccacagttgctgcttcccacatccatccatccagtgagcaaggtggattgctcactgtaggaatgattttccacatttactcaggaggccagggctgcagggtttattctgtgtaccagggaagggagatggaaaagagacaggacctgattggctctgctgttccttgtacaaggacacaatttttccttgtgcagttgtttaatctgattattgtcctgtggctcattctttctttttgtctttgtttattccaagtccctgaggcttccttgggaacgtctgtctacctgtggttcttagacaggggattcctttgttgattctctgtcagtcttaattctatttgtgcatgtcatctgagattttctcaaactttctagtccacttttagccctcctttttgtttccaattatcatttaataaaaagagcttgtattttagagactctggagggttcagaaaagtgagtgtcaagtgttcagtgtgcaatcattaaagacagagaatatctcataagtttgcatctgtgttacttacacgattgtgatttacggatgctttatttctttccctttcccttttatttttccttttgtttcttttatgtatttattattattattatttttagagactcactctaaaaaaaaatagggtctcactgtgttccccagactggaatgggactacaggtacatgccaccatgcctggctaaattaaattttttttttttttttttttttttttagagacagggtctcactttgttggccaggctggtcttgaactcctggccttagtgatccttccatcttgtcctcctaaagtgctggggattacaggtgtgaaccactgtacctggccaaagtttttattttttaatatgatgtataaggtttagaagtgctttattttatttatttatttatttttgagacggagtctcactctgttgcccaggctggagtgcagtggcacgatctcggctcactgaaacctccacctcctgggttcaagcgattctcctgcctcagcctcccaagtagctgggattacaggcgcccaccaccacgcctgactaatttttgtattttttagtagagatggcatttcaccatgttggccaggctggttttgaacttctgacctcaagtaatcagcctgccctggactcccaaagtgctgggattacaggcgtgagccaccatgcccaggagaagtgcttttaactccacacgtgtttaggttttttggtttgtatttgttatttttacttttttccttttactacatcaaaatgagtcctttataatttctgccctagggaattctaataatttttctttgtggtccaatataaaatcatttttaatgtatgccatgaatgtagtcaactattgataataatgtagtactagtagtttgctcagtcagcacaaattgtcaggacacagtggtaatttctgcatgtggattatctcctgattcttagaacaacatgaaaccaggctcatgaaagatgagtaattatcccagggtactgtctccctcacctccaatggtgggccagagctaggtccaagactttgaattctagagtgttagacaccatcctatgcagcctcccactgagtaagggtggtcactgtttgtagggtgtagagtttgatagatacgtctgttactttgacttcattagttttatttagaatgcttgaatgtgtgaatgtattgattaatatattcgttattgccttctctctgtgcttggaagagaagaaaattgaagtttaccactaccatgggtttactttgcgtgctttgttatttggtgtataaagattcacatcttagatcttctgtaggtcatatggtgtttcgtttaaagggaatcttcttctgaagagtttagccttgaattctgctgagatttacattggcaatcctgtttgcattttgtttgccttggacagccatacttttatgcactcctttcctactaatgtgtttattttgcttttgatgttgatatatttgttcaaccaacatttttagatgcccgagtgcgctccaagcactgtctaggtgtcacagtggcgattgggatacagtcctgccttcatggatcttctgggctggtcgaggagacagacaataaaccagtcaatgaatgaataagtaactgcaaaattttagttctgctctaatgtggtagccattcacttcatgggggttatttaaattagttaaattaatagtagcttactcattcagcatgtattgtcggacacaatggtactttctgcacatggattatctcctttgattcttttaacaacatgcggtatgtattgttatcggtcctacttacgaggtaaccaggactaggcacatgaaagatgagtaattaccccagggcactgtctccctcaccctcaactgtgggggtaatttttaaaataaaaattaaggccaaatacagtggctcacgcctataatcccagcactttgggaggctgaggtgggcagatcagttgagctcaggagttcaagaccagcctggacaacatggtgaaaccctgtttttactaaaaatacaaaaattagccaggtgtggtgacacacacctacagtcccggctacttgggaggctgaattgggaggattacttgagcccgggaggcattgcagtgagcggagactgcgccactgctctctagcttggatgaccctgtcttccaaaaaaaaaaaaaaaaattaatttgaataaaatttgttgttcctcacttgcatgtgtcatatattatgtgcttgatagtcatgtgtctagtggatactggattgaacagtgcagatgtgggacatttgtcagtgcacgaaggtttggtagacagtggtgccttagatgccgtcatggagatgggttggttctgaggtacagtgtcaagtcactgggggcacctggagtggtgacctgagaaaacctgaattttgagaaggaacctgtactgtgagggtgttgtctatggggcatgtggtacttgtatttaggattttggtaaaaagtgactattcataagctatttaaagtttctattttaaaagtatagggtttttaggtagtgtgttttcttttgttctaataggaattgttttggtcatattagggaaaataattggcttgttgatacatttttatttccattgattaaatctggtagccattatttacttttatagattgaaaaatggttcagtgtttcaaaagtattttgagcttgtctttgaaaagagatagacaggcaggtgcagtggctcagacctgtaatcgcagcagtttgggaggctgagatgggaggattgtttgtcaggagctcaaggccagcctgggcatcatagcgagaccccatctctacaaaaagtaaaaaaattagctgagcgtggtggtgcacgcctgtagtcccagctacttggggggttgtggtgggaggatggcttttccaattatcctacagatatttttcaaaatgattacttttaaactataatctttttattcagaggtaggatgctagttctacaattgcctaggtcttctttaatttgtatatgttaagaaattttaatgggcaatttaataagtgttgaaatttctaagaattatttctgtatgttagagttgtgataacgcagacattttccctgaagtacttctctgagtctgatttgttttcctccatgggtgccacataggtttcttttaagaaggtaaaaaataaaagctgactaaggtacatattgattattccagacaacatgcagacatcactcaatgagtgcagttctcatcaactcaccatttgtttcaattagaaaaaattctcatcaaaactaatttttctgcatgaaataccttttcaaatcacactgaatgtgatttattaattgtgatttatcaaattcagttttctgctggatactaaaggcacacctcattaagactagtgattatggaaatagtacaatattttagaaacttttgattgtaaaaatttcttttaaaatgaatacatacagatatgttattgttcagatatttaacacttacgtagaaactcactgatctactaacaagtagaaaagagacctttagccaaatgcctctgtactcagcaataaaatgattaattactgtgttgctcttttctctggttaaggcttttaacaaattttgtttttccttttactattacaccataacttgtttaaattttgttgctgttgcagaattacagcagacattacagttcatgtctccctgtgtatacgagggagagtttctctgggctgtgtacatgggggagtgtgggcctgacctgtcacattcaatttttatttcacagtcttatatctaatgctcatcattgcataatgtaactagctggggttagtttcctcagtccctgactcttctcttcagagcctgttttctctccgtttacagatgggccaaggttgctcgggtgattggtttactggcttcgcacaaaactgatctccaggaaaatacacctgttgttgaggtaatgtcttttatgactgaaatgtgatgaatgacaagaaatactgttgttgattctgtaatttagaacatgtggctttccttgaccttcacttgacttttctttgtgggattgtggaaattgttcaaaaacttatcacctcaacagacctttaggcttaaacatagcggctcatttacaatgtagtccatcattaaaatggcacagcagagttaacaaggctcgtgaaccctactcatcattatttcatttgtttttgaataagacttgttcatttcccgttttcttgtagtctgtccaacattttgttacagctaatgtatttcctaattaaatcatagcttataattcaaaattcaaattcttctggcttttagtgttttcgtatgaaagattactttctacctattctgttaatgtatattacactttattggtaatagagtgttataccttgaactgggagaggctcaagagtcagtgtaggtgaaaagaaccaaggctttttaggggaaatagcaagaggtcctgaaggaagttaaaaagggtaagggagagaggattttgtagagctgaagctggttgtgtggtatttggggctttaagaggaattggaaaactttctatgtctgtgttgtccactatagtagccaattggtatttggagcctcaagaggaattggaaacttttctctctgtgccattcactgcagtagccaattgctgggatagtataccagctggccttacagtgtctgggtggagattaatataatttcactgtatttcccttgcttacaattacatctctatttcctgcaaactgttggatctctgagctactagtaaaatgccactaagtctaattgtttccttttttggggggcctaaaataaatgaattgtgacctgtgtgattactgatggtacccaacttggttctcagagatgtgtcgagtagatttttatctaaaagattgagcatatagggcagtattaccaggaagatgagaaggcttaggatcttaaaaatgggggttccttctgatggctcagagcaaaaggtctccagtgagatggagtagctgtagaagatgggagagaacataaagtccaagacaaagtcccaagattttagaggatattcatgcatcgtcagagcaggcatttgttgctcagaagctgtgaagaaagagcctctgaatatgtaaaatatgactgttgaattaaatgattcagtagttgcagtagattatggatactttaggaagctgagttagtgaatttgaagatcagttggatgaattctcttaggattcagaaagaaagaggataaagattgtgaattaaaaaggcatggatgatagtttcagatgtgttccactatccagtatagtagccaccagccactgtggctattgagtgcttgaagaacagctagtctgaattgagatgatcaacttatagaaaagaatactatgggcaccctgtaatttccaaaccccttgttctacttgatctttttcacagcatatatcaccacctggcattttatgtatttatttctctttccatactagactacaagctccattggaacagggattgtgaattgtcttgttcaacactccacccccgtgcctagacagtgtcttgtgtatatctagatactgacaaatattttgaaataagtgaatgaaagtgtatcagtatgcttgggactccctgtagcagtgcctggaagatggtatgttttgctgctgcaggaattctcaagggactgggcagagggcatgtgaagtaatctgggacctgcttgtcaccctgggtgatgtgctgcccttgttctactggtacttgctgttgcggctgctgcactcccacttggagagtttggcccagcagttcctggaccatatttgttacttgtgctcactcaggttgagttctgtggccagtttgtattctcaaagtatttctgctactccagttatactttgtcaacgttgtattcctggtcctgcctcaactgagaggaaagggtgggtgttaattcccgaggttcttgtatctttgattccggtactgttctcttcatgggtgtttgctgatgctttattaatttgaaatgcaagaccttagggaaaatcatacttatttcatttaaaaaatggtgtgtactgaactatctggtgaactgttttgaattacacacactgtattgtgaactacatttggttggatagtagggagcttatataataacttgaaattgagccaggtgctcctttgtgatgccatcttaattttattatttctccacaccttttagttctttagttcgttacttttaatggcaaaatctgtgaatttcttttacatcaacctatttcctgctgtgagcaattggctgtgataatttaaggagccactagaggtcattcaagcactagaaaaaaagttgtgcaagttttaagaatttgtttcaacttctggaagcaggatctgtagaggctgagcaggtacatggtaccacgtttcatctttttcctggttttttagaagtttctgctacaggatgtgtggctccattccactggtgatttttaccatttgagaggaatcagatgaatgaaaaccattatagcctctccagaaaaatgcagtcagcacctagcacatgatttcaggggatctgaaaactctgcggagtccactggtgaatctttggttcataactcctgagaccaggtttctgtaaaactcacaattgggtgcttgtagataatttttcagtaatcagtaacaaaatttcaagtgtaagataaatcctgaattctctattagatttactatcagtgaacaagaaaaattgtggttgaagttcctgtaagcattttattttttattttacttatttattcatttattttttgagacagagtctcgctctgttgcccaggctgtagtgcagtggtgtgatctcggctcactgcaacctctgtttcccaggttcaagagattctcagcctcagccccagccccacaagtagctgggactgcaggttcatgccaccatgccccgctaacttttgtatttttagtagagacagggtttcaccatattggccaggctggtcttgaactcctggcttcaagtgatccacttgccttggcctcccaaagtgctgggattacaggtgtgagccactgcaccagcctggtactttctaatattttggatgctttcttacttgctaagcactttctcttacctggaatgttttttacattaccccctcccccagtgatctaatttctactttctctttaaagcccagctaacattccattttctccatcaggccttccctaacagtcccagaactcctacattgcctggtgtgctgacctaaagccctcattaagaccagtaacaaatcaagcctatcttatcaactgacaacacattctggaaccatggcgtgtccatggataagacatgaagtccttctttcaagacttggttttctggtcctggaaaataccaatatggataaaagaccttcaaagctgctacgatgggtaaggaacaatgcacacagtataccattaaggcaaagaagatagtcttaatcctgtatgaaatgccaatgaagatgtaattaatgaatagacatttcattgaaatgaaatcaaaagacattttccttctctgacataacagagtagaactctctagtaagaacacaaaactgaccagcctgaccaatgtgataaaaccccctgtctctactaaaaagacaaaaattagccatgcatggtagcagatgcttgtaatcccagctactcaagaggctcaggcatgagaatctcttgaacccaaaaggtggaggctgcagtgagtcgagatcgcacaactgcacttcaccctgggcgacaaagcaagactttgttttttaaaaaaaagaagaagaagagaaaaagaaaaagaacacaaaactctggttactgctctatgagaattaagtgaatgtgaaggagaagttggaataatattacaagttggtgaaatattggaattctggtctgttggtgattggtcttcatctttcctataagagatagctcattacacaatgtattctcatttgtctgaacgggattatttcccttaaggcgatggcctcttctgcatctttatgtctctaatgtctagcatgggaactactcaatatatatttcaggttgttgacaatgattgctgctgtctattccatctaggtaagggtttttgcattcaaaaggccctttgccttaagacctaaagaggttttggaacatcagcaagcatccatctcgaggtaaataactggaatcccaatgggctgtgtgtgtgtgtctgtgtgtgtgtgtgtgcgtgctaactggaatcccagtggggtttgtgtgtgtgtgtgtgtgtgtgtgtgtgtgctaaatggaatcccaatggggttttgtgtgtgtgtgtgtgtgtgcgctcatgcctgcatacacatgcgtgcacttctggtacattttgaacaggcatcagattatgttcccacagcccctcttcatcaaaatgaagaccttgtacgtctgaaatacagtttgtgaaagtcaaattgttatccctgtgacatagaacagccgttaaaaatgtatttcactggaatgtcattctaaatgaatatttttaaatagatatccaaaaataagaaaatacagtgattttagtgtaataaaactgatttcacaattgtttcaagaaactcggaaaataaaacttcaaactggaaaaatgtggccataagaatgcatggagccggacgcggtggctcatgcctgtaatcccagcactttgggaggccgaggcggacagatcacgaggtcaggagatcgagaccatcttggctaacacgaggaaaccgcgtctctactaaaaaatacaaaaaattagctgggcgtggtggtgggcgcctgtagtcccagctactcgggaggctgaggcaggagaatggcgtgaacctgggaggcggagcttgcagtgagccgagattgagccaccgcactccagcctgggcaaaagaggaagactccgtctcaaaaaaaacaaaaacaaaaacaaaaaaagaatgcatggagttagttcattcttctcgccccctggaacttctgatcaaaagtcaatacctttgtgacctacaagtctctttatttgccctccattatagactgagctgttaataacatttaatgagctcacatggattcactggctaataaagaagaatagagttgaggacattgctgccctgtttatgcccaaaaattaccctaaactgaaagttgctttgtgttccttcactcccctctgctggtaaattttaatatagttcttaatttttttaagtcaaattgatagaaacatcaattgtgtttttaaaactgtaagaaaaaataatgttgaacatcacaaaaatgtactcaatctttcccaaaacccatttctttccagttagttttcataactgtaggttcttaaaaaaaaaaaaatgaacactttggccgggtgcgatggctcatgcctgtaatcccagcactttgggaggccgaggcgggtggatcacgaggtcaggagatcgagaccatcctggctaacatggtgaaaccccgtctctactaagccaaaatacaaaaaatcagccaggcgtggtggcgggcgcctgtagtcccagctactcgggaggttgaggcaggagaatgttgtgaacccgggaggcggagcttgcagtgagccaagatcacgccactgcactccagcgtgggtgacagagcaagactccgtctcaaaaaaaaaaaaaaaaaatgaacatgtcatccatacttctaaggtgttgtaaagatgtgtaaagttttcactttttgcatcatattcacatgtggctatatgcccttttctcttcaaagttttctttatcttgattacttatcagaggcttgactgttttattatctcagtcttttgaaagaatcctccttcagttttattttttaaatctagtggtttttctttttcctttttccttatgtcttaattatttccccctttttgtttgttttgcttttcccagtttagtggatcaatgtaatttaaattgctttttaaacaaacatgtaagggtatacattttcgttgggtgctgtttgactttgttgcacaagttttaaaatctattttttaatagtttgtattttctaaattattttattacaacttttgttcacattgctcttactattaattttttatttttattaattaattaattaatttatttatttattgagatggagtcttgctctgtagccaggctggagtgcagcggcatgatcttggctcactgcaagctccacctcgggggttcatgtcattctcctgcctcagcctcccaagtagctgagactacagttgcctgccaccacatccggccttttttgtatttttagtagagatgggatttcaccgtgttagccaggatggtctcgatctcctgacctcatgatccacccaccttgggctctcaaagtcctggaattacaggcatgagccactgcacccggcccaaaagctttgtgtttttacagatattagacatgtttcttgtttaagaaaaaaaaatcttaatgaaaacgtaggagaataaaagaaacatttttccaaaaaagagaaatcattgtgattattttatcttattagaatgttggataatatagtctgcttcattaatcatcaagcatgctatgcattttccatttttataggatctgtatctcagttaaggtaatactggtaatttttgtactgtaatcaaagatgaagaatataggccaaaatcatagaccttgcatagaagctggataatgaagacagctatggagaaaaacatagatacacacacacggacacacatatatataaagtatacacacatatattttttaaagttttaaagcttttaaagcaaaagccggcccctcttctcttccagagtgggaggcctctcccctctcttagagtgggtggggagagcagttgccatgggcagctttccttgtgagccacaggtccctctggacacactgctttctggccacgccccctttccttttcatctttctcattgaccaatgggcttggagcattaaggccacgcccctattccgcattctactggggccctggttacgcctcctctggctcagtcacacagctgcctggtaggtgactggaggccttgatcggttctcattgagattttgctgctgtgaccccaaccctgcctccctccccaccctgcgatggcagaagaaactcaacacaacaaattggctgcagccaagaaaaaggtaaaaacgcactaggtcatagcccctcaacccagccacagatcccctctgatgacaagacccctgccagagtctatacgactcctgaggcacactggactggtcccccctaccccggtgcctctgggctacccccaccaaagttttgtcagtcagccccaccccttcagcaagcagcccagtccttgccctcgccaatcaccccagggtgactttgggtgggtgagtcctggggcttcccgctccattactgggccctcatctcctgccgccccaagcttgatctccctgggctctttgggctctcatctccaaggagccaggccccaccctcgccagtcatccctgggtgactttggactggtgactcctgggactccctgctgcagactgtgccctcccctcctgctgcctcaaggtcgacctccctgggttctttgtgctggcgtctccaaggagctgggtcccaaccctgtgcttccctcccccatcgtggagcagcgacttggacatggtgctgacatggtccctccccccgaccaggaggagtggaatgttgtgatgtcacagtccacctagtaactgctgttactgcaagactggcctttgatcttacgacccagtcccctaagcgttctcaccccgtttctggttcctctggtcacagcacaaatttccagctggaaggggaatggagactatgggacctaggagcaagaggttccaggctgcctcactcccttacagatgttgacggtgggaaaagcctacacttcccccatgaactcaaaacgttgacagtatctctgggtggcaatgagagaatgggtttggtttggttttctcccaggcttctactttccagagagattttaacatttttttctgagttctccacctcatattctaattctccatggttctgggaccagactctccttcagtcagtggtctctgaagtgacatttgctcatcttctgtggaatagatcttgggaaactgaacttgacaccttgaatcttcctcatattatctcaaccttgggtactttgagtgccacaggataaatatgggacatctttctgaagcatcagtttcccttgattctcttgagatcaagagaaaaaacatgaatgtacttagggatgacagtcacataggtttctaagagtataccagacctctctctgaaatgaggcttgggttgtcctctttctgataaattctgatttaagagaaaggctgccttctgccatgaggacacattgatataagagtttgagaggtactggtgcacttcttcacactaacagacgtgtgaggatgtgtgactctaaaccacatggcatacagttcctgcctacttaatgtttacttttctacctctgcctctggttttggtccctggcagctgctgattcttggcaaaacctcagagcttggagtcagaagactgagtttcaaagttccagtattgcctttttcttttttttttctagccatgatatcaatccttctcagtcactaaatgagtgtgacaacaccttgtacagttgttggtgtcattaaatcagatggtgtgtaagtgtattttgtaaaaactgtaaaggaggatgtggctgtaggggctgacggttctcatgagtattactgctcttctttccaacagttaaaagaatattggcagaaaaacagccctagagttccagcaggagcgaacaggaacaggaaaacaaatggcagtatccctgagaaagccacttctggtggttgccagccacctagggatgtgagtcttggctgaccaggcttctggggacagggggcccaaggggcaatagagggtaattcttaagattgtggatggactgctgggtactggttaagaattctggctttagccgggtgtggtggcccacgcctgtaatcctagcactttgggaggccaaggcaggcggatcatgaggtcaggagatcgagaccatcctggttaacacggtgaaaccctgtctctactaaaaatacaaaaacattagccaagcgtggtggcgtgtgcctgtagtcccagctactcagaaggctgaggcaagagaatggtgtgaacctgggaggtggagcttgcagtagccaagattatgccactgcactccagcctggtgacagagcaagactctgtctcaaagaaaaaaaaaaaaaaaggaattctgggtttgaatcctgcctctccatctgctctgctagggatatgatttagggcaagttgctagacctcatcgggcctctcttttcacatctgtataatagaggtgttattgtttcacttccatttgtgaagtttaaatgagatttgttattgttgtttttatgttaatccctagtacatggcctgctgtaaacactcagaacacccaggatatggtttgattttcctcatccccagtctcagggggaaaccaggacaatgagaacagccacttgccatcaggagtcactgaaggggccccaggatgggatggtggggagataagaaccatgagagaagttggcacaaaggagttatgggacaaaaggtccaagataggcagaaaagaaaatgttgccagttgatggggaagaaaggaagtcagagggctcagacactgtgggggacagaacatctccatgtgcactctcatctcttgtagtcagcaacaggtttccacagggaaggccctacatcatctgctaccctgaaagatctggaggtaagaggctctgggcggaggtgcagtgacccttcgggtcaaccctccaacctcctcctccaggtgggactgggtgcccctctgccagctgagacagcccacacaccccagccctaatgattgttctctctacctctccccccactcctgctccacctcctcctctctgcatgcacctcagagcccgtgccaagaacgagcagtagtcctggattcaaggtccgtagaaatcagtcaactgaagaacaccatcaaatctctggtaagagtccactggggtcccctgattccacgctgccaatcctgggctccagtttccccttggggccctgaagaaaggggctgggggtccctggtgcctgggacaaatagggagcttgggtgcccaggcctcacctggagggaccccagagcatgcagcatggctcttcttttgctgccctctttgccgactctctcctctccagacacccctgctcgagtccttgctacacacgccctggggttgttgcctcttggggaagtgctagcctgactggttgtcaagggccccgtatttctgccatgactcagtccctaatttgctctttgattctggacaagccacctctcctttttgggctcgtgtttccagaggaggtagtgagtatcaaaggtctctgttagctctcgagtctgagatttaaaggccccctagaacggaaacctcagggctaagggctcctgtctgtccttttccatcctatatctgctgtaaagaaccgtacctggcccatacatgctcagtaaatgtttattgaatgaacccacttctctaaatcacaagctgccagaaggaggggcctttctgaaactccatctctagaggtttatattgctgtcctctcaagagattccagattcagactttgagttctgtggctgtgggcaaaagccaacaaagacccaaatcctctgtccttgggagcttgaggagagtttaccggttcgtgttcccattatgtctgagaactttgcctttaaaatccattcctggcccctgcctaccgcttcctggtctggggaatagagttgagggggccaccctcccatccaccttatttgactctccccacagaaacaacagaagaaacaagtggaacatcagctggaagaagtaacgtgatttcgtttcctcgcaacatgactgctgggtttggggggcactcagacatacaggccccagtctcgtctcacccactcccagcctggggatgaaggctcacccttcagattccaccccatccccacagggcccctgataacctggtcccatgggtgggcctgtcctggggcattggtggcattctgggggcatgtctcttgctgtgccatctctgcctccccctggtaagagctctgtcttcctcttcctacaggaaaagaaagcaaacaacaagaaacagaaagccaaaagggtgctagaggtgagtggagggtgtgcagtttcctcctgtcctccggagaaggtttctttccttctctttcagcacttgcttggcttttctcccaaaggttcaaatccagacattgaacatacagaaagaggaactaaatacggacctgtaccacatgaaacgttctctcagatactttgaaggtgggaatctgggcaccctgtcatccttcaacctggcactttgacaggtcttcagggggagtcctttgggccccatctcaactctctcattacagaaaagtccaaggatctggctgtccgcctgcaacattcattgcagcgtaaaggagagttagagagtgttctctctaatgtcatggccacacagaagaagaaggcaaaccaggtgagtccaaccacctgccccatcccctgggagcctggctttgcagatggaggagtgagcctaaaggtcccttctgcaggatggagtgtcctgcccagaaggcagcatggccatttcttgctacttttttgtatggtttttagtggcagcctggggctgagtcagctgctgtgggtgagttgggggtcactgtgtggagtgagcactggacgcagagcttggaggccaagtgcctgccccgcccttacctggctgtggtcttgggcaagtcctagtcctaggtggggtattgggtacttgtactgtgaaggtacagaagagtacctttagtatgttaccatttctgtagaaagaggaaacgtgtgtgcgtgtgtgtgtgtgtgtgtgtgtgtgtgtgcatactgtgataatatacataaaacatgtctgcaagggttcataaaaaagtcaggagagagcaacaagatggccgggagatacttcccttctgtaccttctgagttttggactatgcaaatgtatcatcctttcaaaaagtgaacaaaagattaattttccccttcctatctgtgcccccatccccagcaagaaaaacgggcttagagaattggatagacctgggtgtttatatcccagctctgcctaagtgaacttaggcaagcacttaacctcaaatactccatgttttttcatctccacaatagagggaatcatagtaactgtctcctatggtggttgcgaggattaaatgggattgttagcacggtacctggtgaagcattccacaaaggttcaaacagtggtaataataacagtaataacaatagcaatattatctgatctctctgggcctctgttagccagctataaattcaatctcattccctgtccgttccaactttactgagttcttttaaaaaccagaccacgggcttggaaatgccttgatctttactgaccgagttgtatattgggcctagccctagcccttttaaggggcactgtgtggaaatgcccaggctctccagattgaaacttctcactcttcaccatccagttgtccagccgcagcaaagcacgtacggagtggaagttagagcagtccatgcgggaggagacactactgaaagtgcagctgacacaggtgaggttttctgagggagttatgtggaaggaagatgaccccaggtggccaggagcaggtgaggaccagtgacagcccttcctaagttctgtgcccattcttgcagttgaaggagtcatttcaacaagtccaattagaaagagatgagtattctgaacatctaaaaggagagagggcccggtggcagcagaggatgagaaaaatgtcgcaggaggtgagatctgacccttcagcccccccacattagataggtcactggatctttctggtcatctgtaaaatgggaatagtagagccagaggtggtcatgggtctgggctttgtggaggtgggggcagagagggagagggcagcctgtccagccaccagcccctctctccaaggccctttccccttgtgctttgggcagatttgcacattaaagaaagagaagcagcaagatatgcgtcgggtagaggagctggagaggagcttgtccaaactcaaaaaccagatgggtaagatggggctggcatgacctaggagcaggactggcatcagagggctgtgagggtggcttagagtgccccagggaggtgggtggatggaagggctttgaggcagagggaaagagatctgtgccaggagacggcgagtcttgtcatctcaatgagtctcagtgtctcagtgtccccatcaggaaagagggcccgttgtcagccacccgcagtgctctttctctgaaagtgctttggaagactggctaccatctgggtgcgaggaatcattagcagtgaggccaagtttgaggagcctgagaggagctgtgcgccaagaggagggtttttcttttccgagaatccagaggcccttattatctgcttcctttgtcagctgaacccttgcccccggagcccccagcagtgccctctgaggtggagctgcagcacctgaggaaggaactagagagagtggcaggagagctccaggcccaggtcaaaaagaatcagcgcataagtctcctgaaccagcgacaagaagagaggattcaggagcaggaagagaggcttcggaagcaggaggagaggattcaggagcagcacaagagccttcagcagctggccaagccacagagcgtcttcgaggagccggtgcgttgcccaaactggggagcttgccctcctccctagccctccgggcctttgtttccccacctctaaaatggggcagtgtagccctcacatgaaatgttacttctaaaggcacctgtgagccaggtggctgtgggagagagggagtgatttttctaacctgcctccagccttcccagtgccatgggaggcagacaccaagttctggggtctccagctgcagtgggtggctgctgattgcttctctctgtccagaacaatgagaacaagaacgcactgcagttggagcagcaagtaaaggagctacaggagaagcttggcgaggtgaaggagacggaaacctccaccccatccaagaagggctgggaggcgggcagcagactctggggaggggaggtacgaggccagaggcagcttccagcctgggggctggtgaccacagcaccccccagggcagtcctgtttcttgcttcctgcctctgacttttaaaggtgggtagccctgggatcctctcaggtctggacatcatcatcctagctagaggcatggagcccccaatcacaggggaagagacagtggtataacaggctccttatgccaggtgcagtggctcatgcctataatcccagcactttgggaggctgaggcaggagaatcacttgaggtcgggagtttgggatcagcctggccaatgtggtaaaacctcatctctactaaaattacaaaaaaaaaaaaaaaaattagcaggacattgtggcgcatgcctgtaattccacctactcgggaggctgaggcacgagaattgcttcaacccaggaggtggaggttgcagtgagctgagattgcaccactgcactccagcctgggccacagagtgacactcttgtctgaaaacaaaacaaaaagactccttagattaaaactggattccagcctcggttgcactggtcaccattcaagtactttgcatctctaagtctctgtttctttaacttcaaagggaagttagcattttccttacagaggtgctgaggattaaatgagaagagggtatgagatttgaggctggggaaggaggcatggggttctaggaaagggaggcagtcacttaggcctggagtaaggggacaggggcctgggcagctgacagagccccacagtgccctcgctaccctattaatgggcccagaatctggaaaccagccaccacgtgccctcacacccagggtcttcctgcaggtggagctgaagagccaagaggctcagagtctgcagcagcagccagaccattacctgggtcacctgcagcagtacgtggccacctatcagcagctgacctgttagaaggaggcgctgtacaggcagtgactgcaacagacccagctaatgaaccagctgcagcagcaggaagcttggggcaaagcggtggctgagatggcctgccaaaagttgcaggagacccaggggagggagctgccgaggatggggctgtgagggggatgacctggcaaactccaccccttctcactctgtcctggcccctcaggagcacctggaagctgccagccagcagaaccagcagctaacggcccagctgagcctcatggctctccctggggaaggtacgggagactgctcagaggaagaggagagagccccaggaggaaggggggactgctagcagcataggattgaggagttggaagagacctttagaacagctggtcattatgccgaccgggtgcctgcactaagttcggcatcagtgtggtgacctcctgtgagcggggggtcaccaagttgcctaaggatggctgaactggccaaggtcagaaagggagcaggtcagaactcccacatcgaccagtagtgggagtgtgcctgggcggaatagcaagatcttgattcttaaaagtaaaaataaagaacaacagctcattcctctctggggaggggctggctcagggttacacagtgagggtggaggtagaggtgggcccacagtacctcccttgttgggttgtctgaagacccctctggccaccccccacaggacacggaggagaacatctggacagtgagggggaggaggcacctcagcccatgccgagtgtcccagaggacctggagagcagggaggccatggtgagcctgactccccctgcacccattttgccacctttctctgtggtccctccaagacccctttatgctcttcgtttccctgccttctgatttctctggaccctcaccccttccgagagccagtggtcagacaccatttcacctgtggccaacaggtgcactctctgaggccccaagggaaggggctgcgctccacctctctgccccatttcttctgtgtatgcccctagaagaatgctcacatcttgccctcaggtggcatttttcaagtccgctggagctagtgcccaggagaagcaggcacagttacaagagcaggtgaaagagcagagggtgtgctgccagcgcctggctcacccggtggcctcggcccagaaggagccagaggcagccagaggccctggagccccagggcctgggggcgagtctgtgagtagggagacccactgggccctgcaggaagtcacggagaagctggcccatgccaggactcacctccaccttctccatgacttgaaaatgccacctgagggcaggtcgctgccgagatgtgactgcaatattttggctccagagcagctttatggaccacctgaaggagaaggcagacctgagtgagctggtgaaaaaagaactctgcttcatccaccactggcgagacagacgccatcagtgagtgggaggccagggcacggcagggggagctacagggccgtcggaggggccccagcgtctgagccctgtcctcccgcaggaaaacccatcaccttttatcagaaccagggggctgtgccaaagatgcggcactgggaggaggacaccatcaggctggagctcagggaggagatgaaggtagggtgtgcaacatctctgtgggggtgggggtgggggtgggtgtgagggtgggcgcaagcagcggcatggcagctgagcacccctccctccaggtgaagctgctggagctgcagcagatggtattgcggcttacagcaactacaacaatgggcacagaaaattcctggccgctgcccacaaccctgctgatgagcccggtccaggagccccagctccccaggagcttggggctgcagacaagcatggtggtgagtagagccctcaggtggggtgggcaggcaggaagagggggctcccactgtgctcagatccctgcctccctctctccaaagatcttcgtgaggtgagcctcacctcctctgcccaaggagaggccagggaggatcctctccttgacaagcctactgcacagccgatcgtgcaggaccaccaggagcacccaggcttgggcagcaactgctgtgtgccattcttgtgctgggcttggctgccaagaagaaggagataaacatcaccatcctcaaagagctgctcaagaaatttttaaataagaaaccaagttatggggttaatctcctacacaattcatttacttcctttgaatgttagactcactcatgattatttgtgtttctaatttatagtttaagtttatttgtaaaaagttaaaagagagtgggtgtctgtggctctcactgatgttcactctggcatcctttagcatttttcttttttaatttcataattgtaggtcattagcgtgcatatcgagtttgcccttacgtggtgggagttcaaacacacaaagacccactctttgcccaaaactgttctctttggtttggaataggctgccatgcttttttaatgttattgcagcatgtatattcactacagcattcagacaaaatttgcctatgttctgctgttgtttgatctaatcttaatcacagtgagctcttccttagctcaatatgtagtttgcccccaagtgtgcactgtttattactttgtaatacgccactatgagtactgacatttagagttgtttaaaggccaagaactggaaacagcctttcctccattttctgtgtattggtgatgggagtgataaccttttgggggagctttttaaatctcacagaagaggaaagtggcctcctctggcaggtatgtgcaggatagagtgtgtttcatctgttccggtgccaggaattagcggtgtattatggtggttcccttaggatttgtatgtgctctgggctcatgaagatattgcatcatgagctgcagcagttgtactctttttcgatgacctaaaaagggcttatttctgaggaatgaaaggttcccatcgttgactgtggatgtggaaaacctttcctagcttagagcatttgtatctacaatacattttaaagtcagagttcatgttacctgttttaatcacatgactacatgtcccagtacacaaaagggcactggttggcattcttcttaatgtatttagtgaagatcataagaaatcctttatgagttcaaacgtccctggaacaggcatacaggctctagtcaagaatgaattagagtgaaggaaagctgtgtgacacctggcattcctctctgttcacggagattctttgaggcttgaagattgattttaccatctagacctctttggctaatacctattcttcaaccaccttggttactctgacataggaatttacttctttttccttgaatggaaaacactttaaaaaataatagaaacattattataaactaatatatgtgagatacttagttgaaacaaaaaggagttttagtagatggtattgtactctctttgaaaatcaaggagaagtttatgaaacttaaaatgtgtacaaactgcagtgcaatctactgttcgtgaatgtcaatgtattatcaggaaacgtgtctatacaatcacagagttatattttctcacagacttctttacaaagtgaaatatgtttttgtacctctgggtttctgttcgggacatattttgtgcgatatttatgtgattgtgcctatgcatgatgaatgaatacatttcagttatatattgcctaaatcgtaacttgatgatgcttgggaaagactcaacagttaaaacttcatgaagttctaatgtctgtgttccaaaacacatcacattgttaggatgcagggagataggtgtgtgtgctccctgcggtggggatttctagttactagatcatctccatttttagcatttggcatcctcatgatacttctataaatatgacattaacaggagagcaacaatacgattttaccgatggaataacagatttgctggcattcactgaaagagtgcaaatattcggtccttgtgacttccactgactcttccaaattttatgaatgtatcaatgtattagataaacccagtttcagaatgataaagaaaaaatcttagaccaaataatgcggctaattaacagtggtacgatttgtagcccgtgggtttaaaatgcacttaaagtcctgttctcgccttttattttctgaacttgccgcttttgcattctttgagttcagtttaaagacagttactttaagagcattttaaaccctcgggctagaaatcggaccactgttaatcagccacattatttggtctaacgttttttcttttatcattctgaaactgggtttatctaatacattgataaattattgcaaaggtacttttatcgttgaaatcacttcacttttaccctgataaatatcagtgactaggaatgaccttcggatagcgtttagcatctgtaaccaatctgacaataatgtgttcatgaggtgcctatggattaaatcacacactggcatatttaagctgaaggtcagtctggaaaataaatttactatattgactgaaataccactctttgtgtaggcatttgtcatatacttaagaaaacgctaaaaagaatggaaattgtatgacaataacttaagtctttctccaaagtgcatgcagtcttttgcgatacctcattcagccgagtatttgtgctcttcctcattcagtataaggcagctttcagtttgcttagaaggcaacattggaatgttagagttcatcagaaacatagaattttaaactgtgagttccactgaatacattttaatgtctgtaggaagaatcaaaacacctatttaaagatggcaatatataataatcattttaaaagtatttgattcaacctgataattttccagaaatgaaaaaaaaaatcagctctaaaaccaaagcgattttagaaaatttgaaaatgtaaatcagccctatccataatatagtttctctaaaactttatcttagtcattttaaaataatataactattaaaaaatgtaactgctatcttaatgttctgaaataatttaaaacattttaaaatatgaatactgtagtataaaagaaagaaatggtgggaacgaaaagcagagaaagaaatgccaattccagtccaaagttttatttgccaagttttcttagaatgaattttaccagtttatgaattattgtaaacagaatgtgtcatggaaatactgaaagatttttccctagagtggccttattgactgctggtgtgatgccactgtaatgtaataaattattaaattgtttcaatgtgttgtttttgccttaaaattttattttgtgtttcttgaaaactatagtattaaaggtattgatactgtgcaaatgctgggcatgcttggcacgagataatgtgtttcatttttacaaagttgtgatataactatgcaagtgtttcttaaaagaacacaagatttaaaaattatgggattaaaaaaagttatggggtgaaaaagttatgggataaaaaatgtaaaaacgttgtggcaaaaaaacttgtgggaacaaagtagaaaacagtattatgaaaagttaccaaaaaagttatgaaaaagaagttacgggattcttttttaaaaagtcatggaataaaaataaaaattaaaagcaggcccctgtcagcaaagcctggagaagtggggccggagtctccaccgccaccatgtccctaccaccccttcccaggcacccctttacaattagggtagcaggacaagacctctgtctaatggggaaagacaaacagaccctttgccaccttgaccagggctgagtccctaaatttctggatgatgatgattgttatttaagagccagaggctggtggagttggtttgtttggaggaggcctgatgtcccccttactctcaccatagcaacttttccctcaggggggctcccttcttattcagagaggtaggacagtggggctaactgtggaccaggcgagggcacgggctgctggggtggcccccgttccccggtgtacacattgtgtctgtgtaaggttttgtatattccagagggtagggccacccctgtgtcatacctagctgaggttggagccggcacatggggaggaggttgtaataattatttgtggctgggaaacttatttattgctagcataggacagaggaaggaggcggggatggggtcgtggctccctggtgatgcgactcctgtttattttgctttttattttggaataaatggatttagccatactgctcggcctggtgtgttcccgtttccctcactgggtcctggagtttgtgccaccaaacgaggagccccagagtgtcttgagtatgtccagctaggctgttagggaccttccaggcgtgttacctgtatgctgcctagtggcgcctgggggattccacggggactgccatggtgcctatggggcgcagtccagccctgacagccaacaggctcagaagcctgttgtagcggtggccaggaagacaggtaccagcacctaagggcactgacttccacccaccccaggcgtcttcccttccgtcaccttgcctccctcccctgtctgcacctggtggcctgttctctctgtccctccagagtgccggctgcccggcaggctcccttcaggctgagttcgtggccctgccccctggtggccagagccggcttcacaggacaagagccagctaagttccaggggctttccaggaaaagtgtcccttggaaagggtatggccttttcacccctccaaacagcaccctagaaatggcttggcctttcccctcccctgagctccacagagaacacagccagcagaggacacacttccccgtcatccagaaatgggtttgattctcagccaagggacagcaggactggtagagactgtcaggccacacagctgcctgcacagcactcccatgcttggtgggggggcgggagggatggcgggggctgactctccataggccaggcgtgacagggagactcaccggaggtcttgcactttggaggggcaatgtcgggacagctttctcttgttgggccacaagactccaagaggacagcacggtgactgattcccagcactagaggcgaggccgttggccacatgtaggtgtaggggtgtgtgtgtgtgtgtgtgtgtgtgtgtgtatgggtatttatagatatttatagaacaatgcgagggcataccacagaggggggcacaagtttcacaacagtcacacctggacgtgtcagctcaccactacaacagactaagtcacagatgaagggggctggctttggggctgggggagccactgccaagtcacagaacagccgcccaggcaggcttggaaagggaggcctccgagaagagaagggatctgtttagaggtcgaaggggggcgtggggctctcaggatgggatggacttgcgtgacctgatcggctggcagttggagagaaagcagagagaaaagaggagagagaaaagggaggagagagctggtgaggccagtgcagagcacaggtgtgccacagcagctgtgggagggccagggaggggagggcgcaggtgcggctgtggcaaggttcctggaaaagaggggctggaagggaaaggggaggaagatggagggaggagccggagcttcacaggtagtgcctggggactgtggcggccctccccaccccacacatgctggcctcttccattgcacccaggcagtgtacccacaggtcagaccaacgctcggcccctttgggcttccctcttctctggtcaccaaccaacttgtcttccaagtcgtcttccaacctgtcttccaaccaactggtctagggccacctctcaccttggggaacccaacataacagccaccaggcctgacagaaggaaaattgctcgaacaaggatgatgaagctaaatgggatggatggttggagtgatcgccggagccccctctgggtggtcaggaagctcaggaccctctgaagggaccctgggggaggcagggtgggcaggcagccagatgccactggctataaacttataagtctaagaggggagcctcagcttgttggagattgcaggtcccataggtgaggctgggtccttcctcccagggaaaggagacggagaccatggcaagggaggtgggtgggcttgctgggcagagctcagctgggccagcaggcactgggctcccctcggctgaataggagggccaatctctaggagcaacaagccaaggtgcgtgagcccgctggctggtggtagtgcttcagcggggcccagggaccctgccttcagtcacatgctagcagctgtgatggtacctgggagggagggaagggggctgtgtgcccctacctgacctgtgaggtgtgttttgggttgaccatgtgtatgggactctcgaggttttatcctagatcaccactgttttgccaacagatagaggaggtgggaccctatcacccctgctctgcagtggatttggccctcagcactccaaggcatccaggctgggagctggatgccccaccctggcagcatggctcagacagcacaaaaggcatggtgtgcccaggatgacattcctgggcctctggccacctcagagtacagccccacacacaaccccctccaagctctcagcccttacaccataaaccacgagctccctgatggctccagagaccacccacatctgccagcttgggcacggagcctgttccaagagcccccaggctcagccatgggggctggggagacttggggccataggggccagccctggtacctgcgtctggcaaggacgctctgcacctgcagccaggagctgtccacgggcccccatgtgcgtgctgatggtggttgtgttgatgtcaccgatgatgctgagcacctccttcagcacgtggtacatgcgcagcatctcatctcgccactgtgcctgctctgccaactcctccatcagcgtgttctggttcccatgcaagtacaggttggacagcaactctgataatatgagctccttggtctgagagggggcaaagagggaaggaggttgggacctgatgcatgtgctggcctgatgcctgtgctgggacagtgtgctggacttggagccctgagtatggctttgcacacgcggcttctacaccgcttagactcaaagatctgccaccccaccgcccttttctcactcagatagggacactgaggtccagaggaaaagtcacctgtccaaggtcacacatctgggaggggacccaggacctatcatgccaccaggacacctgtctactcagtttcttaaaaatgttttttggagataggatctcgctctgttgctgggctggagtacagtgagcaagatcaccactcactgtagcctgaacctcttgggctcaaagtgatcctccaatgtcagcctgtcgaatagctaagactataggcatgtgccatcactaagcctagctatttttaaaatttttgtgtagagaccaggtctcactatgttgcccaagctggtctcgaactcctgggctcaagctatcctcctaccttggcctcccaaagtgctgggattacaggcatggaccactgtccctagtcccacattatagttctatgagacagctctggtctggactgtgcctccctccctgaacctggtcccatagggctggtcggcatctcccccaggccaacatggccacctgcatccccagtgccacaggagccccctgcccctatgaggtggtgcatgcacgttgttgatcatgacgtgcatgacggtcttgggcatgaaaccaactatgaggtcccacacagtcttgttgacaatggccttgtaggagtccacaaggttctgggtggtttccatttgccgcttcagctgtgggtccatggagtggacttaagattgagtctagacctagactgctgccgggctttgcaaaacccaactggagttgggtcctgggctgctctctgtggttctgaagcaccatctcccaccagtgtggctggttccccttaatctgcatctctggtgtctcctatacagcctctgccagaaattcaaaagcagagagggcttttattttctatcttccaaaataaatttcaaagtattattggcaaacttgaatagtgacttctgtttcataatttttcatcgccttttggtttcatctttagaaagttttttaagttatgagaatttttctttcccttagaagttgatgcacataaatccccttgtttgccacattaatggcagaccttactttcccctccccgattcctgcaggggatctccaaaaatctaagcgttaggaaagagcccagccaatcgcatcccagtggtatccccacccttcttcacctctcccagactgtagccttgccccaccctctcagccaccagggacactcacagggaatcttgttaatctcattgaagaacttctccttcagtttggcaaacatgtcctcctggctctccccagcactcccactctcggtggagttgtccacgggtccaatgggcatcgtgacggtggtggtggcaggagccacaataggctcttggttcctcttgaaaatgttcctcatggtggcagaggggacagatggggatgagaggggaagagggcagggtgagcatcccagaggttgtcttcccctcagaaagccatgcccaaaggaccaggagaagctctttatcgatcaaagatattttgcataatattaacaactgtagtaaaccaataataatagacatcatccaattagtacacagtcagcctgggtagcatagcaagaccctatctttagaaattttttttttttttaattaggcatggtggaggctgaagtgacagaggatcacttgagtccaggagtttgaggttacatgaactatgggtgactaagtaaggttctatctcttaaaaaaaatagtagtacatatatgtgccaagcactatgcaaagcactttccatgcattattcatctaatccaaaaaataacctaatggtttttattgtttccatttaacagatggggaaacaggttcagagaggttagaaagtttttccaaggtcacttagctgtaagttctgaaactgaggtttgaactggtctacccaactccagagcttgtatagctaatcactctcctatatctcatttaaatctaacctcaccactctaggaaggagacaaggttttacactgagggctcctctttcaacctctctccttgacttccaaggatttctagatattactctgcctagaatctctgcccagctccatgacacttgaactctccacatccctgactccaattcctcctcctgccctccaagactcctcagccctctgtagtttcttcatgggctccctcagtgcccactcagggtttgttttgacctctcctgtaggaagacggcacccacatctccatctctagcccttcctcccgggtccactctgtagcccctactccaagttcatctctagccctgcccccacatgcagctgcacattagccttcctgcatcaaagatgtgatgtttattaataacataacccagacttactgtagaaaatttggggagagagagaaatccccccataattctaccctccaaagtcaactagcatttggggcattctatgctggtattttttctgagtatgttttacatgttgaggccatgctatgcatagtttttttgaagattttttacataaaatttcatcataagccttttcctttattgttttgtattattaaatagctacagaatatcgtactacatggtaacaccataatttgtttagccattccactattagacatttaggcagttttcaactttttgctagtaaaacactgagcatatatgttggtcttcatttaaggcaatgttcttacgagcttccaaactctgcccccccataattctgtcctctccaccgagctctttttgctcctcggggctatgcactcatttctcaactgaaagtcctatgagggaagatcctgtgttggcaacagcacccctcctgccaagcacacagtgggcactcagggtatttgttgattgaggtcctctgaggcaacatagcagcatacacccacaggtattccaggatgcaggaataaacagcacaactccctgaagcatccgttttactgaatggcaatttacagtatttttaaattaaaacaagctggaaatatagagtaggatgcatacagcacaagaatttaaagaaaaaatgtgagacttttcttactgcatgttagggatgtgttaactctcctctggactcagggttcttctgaaggaacattttagaagctcttaggttctgtcccttcctttcaaaacctgctgagatcccctccccagccctggagactgctccagccttaagtacttttggtgacctgcacattgatgcaatgtaggttcattcaccaagcatttattaaactcttactacctgccatgttgaaatagccttgaccccaaaactggtcttgaagtgaaaaaccaaggtccactggacttcacctctggggacaaagagatgggtgcagtttggcgggaactgcaagtagccacacaaggggataaatatgtgtccagggccttccgccatgtccatctcccctcacttctacaaaactgttaagggctctgtgacctttttttcaaaaaacagctttattgagatgtaattcatatataagtcacccattaaagtatacagttcagtgcattttattgtattcacagaattgtggaacaatttgcataacctaagtagaacatttttgcgacctcaaaaagaaacccagtcccattagcagtcacttttcgttcccatcctcttcccagctccagcaaccactaatctactttctgactctatagatttgtctatcctaaacatttcctatcaatggaattataaaatatgtggtctttgtgactggcttctttcatttagtatgatgttttcaaggttcatccatgttgtagcatgtatcagtatctcattccctttttattgccacataatattccatggtgtaggtagaacacttttttttttttttgagacagggtctcactctgtcgcacagctggagtgcagtggtgcaaccatggcttactacagcctccacctccagggctcaagtgatcatcccaccgcagcttcctgagtagctgggactacaggtgcatgccatcacaccaggctaattttttaattttttgtagatatggggtctccctatattgcccaggctggtctcaagctcctggcctcaagcaatcctcccacttcagcctccgaaattttggcattacaggcatgagccaccgcaccttgcctagaacacattttatatttatccgttcatcaatttataaacatttgggttatttccactttgggctattttataactaaatatggctaataatatcccacttgtggggtattatgaataatgctgctgtgaacatccatgtatgtttttgcatggacatacgttttcatttctcttgggtatatacgtaggtatggaattgctgggtcataactatgtttgacattttaaggtgccagcaccaatttatgttcccaccagccatgtatgagggttccaagttttccacatcccagacaacacttctttttttttttaattatactttaagttttagggtacatgtgcacaacgtgcaggttagttacatatgtatacatgtgccatgttggtgtgctgcacccattaactcatcatttaacagtaagtatatctcctaatgctatccttcccccctccccccaccccacaacaggccccagtgtgtgatgttccccttcctgtgtccatgtgttctcattgttcaattcccacctatgagtgagaacatgtggtgcttggttttttgtccttgcaatagtttgctgagaatgatggtttccagcttcatccatgtccctacaaagaatatgaactcatcattttttatggctgcatagtattccatggtgtatatgtgccacattttcttaatccagtcttatcattgctggacatttggcttggttccaagtctttgctattgtgaatagtgctgcaataaatatacgtgtgcatgtgtctttatagcagcatgacttataatcctttgggtatatacccagtaatgggatggctgggtcaaatggtatttctagttctagatccctgaggaatcgccacactgacttccacaatggttgaactagtttacagtcccatcaacagtacaaaagtgttcctatttctccacatcctctccagcacctgttgtttcctgactttttaatgattgccattctaactggtgtgagatggtatctcattgtggttttgatttgcatttctctgatggccagtgatgatggcattttttcatgtgtcttttggctgcataaatgttttcttttgagaagtgtctgttcatatcctttgcccactttttgatggggttgtttgtttttctcttgtaaatttgtttgagttcattgtagattctgtatatgagccctttgtcagatgagtaggttgcaaaaattttctcccatcctgtagtttgttttgctgtgcagaagctctttagtttaattagatcccatttgtcaattttggcttttgttgccattgcttttggtgttttagatatgaagcccttgtccatgcctatgtcccgaatggtattgcctaggctttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcgtttccccatttcttgtttttgtcaggtttgtcaaagatcagatggttgtagacatgtggcattatttctgagggctctgttctgttccagtggtctatatgtctgttttggtaccagtaccatgctgttttggttactgtagccttgtagtattgtttgaagtcaggtagcatgatgcctccagctttgctatctatgacaaacccacagccaatatcatactgaatgggcaaaaactggaagcattccctttgaaaactggcacaagacagggatgccctctctcaccactcctattcaacatagggttggaagttctggccagggcaatcaggcaggagaaggaaataaagggtattcaattcagaaaagaggaagtcaaattgtccctgtttgcagatgacatgattgtatatccagaaaaccccattgtcttagcccaaaatctccttaagctgataggcaacttcagcaaagtctcagtatacaaaatcaatgtgcaaaaatcacaagcattcttatacgctaataacagacagacagagaaccaaatcatgagtgaactcccattcacaattgcttcaaagagaataaaatacctaggaatccaacttacatgggacatgaaggacctcttcaaggagaactgcaaaccactgctcaatgaaataaaagaggatacaaacaaatggaagaacattccacgctcatgggtaggaaaaatcaatatcatgaaaatggccacactgcccaaggtaatttatagattcaatgccatccccatcaagctaccaatgactttcttcacagaattggaaaaaactactttaaagttcatatggaaccaaaaaagagcccacattgccaagtcaatcctaagccaaaaggacatttgctattatgtctttttgtttaccgtgatcctggtggaggtgaagtggcatttcattgtagttttgatttgcatttccctgatgtctaatgatgttgcatatcttttcatgtgcttaagggccatttgtgtgtcttccatagagaaatacctattcaaatcctttggtcatcttaaaatattttgtctttttattattgagttgtaagaatttgtatatattctgcataccagttccttgttgaacatataatttgcaaatattttctcccattctagggttatattttcattttgtgtgtgtggtgtttttttgttatttgtttttgagatggagtttcactcttgttgcccaggctggagtgcaatggcacaatctcagttcactgcaacctctgcttcccaggttcaagtgattctcctgcctcagcctcccaagtagctgggattattataggcgctcaccaacatgcctggctaatttttgtatttttagtagagacggggtttcaccatgttggccagcctggtcccaaactcctgacctcagttgatctggcctccttggcctcccagagtgctgggattacaggcatgagccactgtgcccggtcatattttcagcttttaatggtgtcctttgaagcaaaaaagttttcaattttgatgatgtccaatttagctatttcttttgttgccatatttttggtgctatatccaagaaaccatcactaaacctaagggcactaagatttactcctttgttttcttatgggagttgtatagttttcagtctcacattcaagtctacaatccacttattttttaagacacggtctcactctgtcacccaggctgaagtgcggtggcacaatcatggctcactgcagccatggcctcctgagctcaagtgatcctccagcctcagcctcccgagtagctagactacagctatgtgccattacacctggctaatttttaattttcttctagaaattaggtttcactatgtttctacaatccactttgagtatggcataaggaaggcgttcacattcattcgtttgtatgtggatatccatttggtgtataacatttgttgaaaagactattctgtcctccatccaattgtcttattcccttgtaaaatagcaactgaccacaaatatgagggtttatttctggactctcaattctatctgtatgtctaacctcatggcaataccacactggttttattttttattatttttttaatagcacctgcctactattgaccatactgtcttgattactgtagctttgtagtaagttttgaaatcaggcagaatgggtcttccaactttgttttttgtttgtctgtttttgagccaaggtctcactctgtcacccaggctggagtacatggcgtgaacatggctcactgcagccttgacctcccgggctcaattgatcctccaacctcagccttctgagtagctaggactacagccccatgccaccacaactggctaatttttgtatttttgtagagaaggggtttcaccatgctgcccaggctggacttgaactcctgggctcatgcaatccacccgccttggcctcccaaaatgctggtactacaggcatgaaccactgcaccaggcctgttcttctttaatcaggatgttttggctattctgggttccttgcatttccatatgaattttaggaccagcttgttaatttctacaaaatagctggaattttgataggcattgtgttgaatctgtagatcagctcagggatcatatcaacaatgttgagttttccactattttcccacttatttagacctttaatttccttcaagattgttttgtagttttcaactacaaatcttgcacttcttttgttcctaggtatcttactctttttgatgtcattataagtggaactgttttcttaatttcactttcagattgttcattgctagtgtatagaaatataatagatttttgtatctcagtcttgtaccctgccatattgctgaactcattggttcttttttttttttttttttttttttttcagacagagtctcactctatcgcccaggctggagaacagtggtgcaatctcagctcactgcaacctctgcctcctgggctctagcaattctcatgcctcagcctctctagtagctgggattataggcatgtgccaccatgcagggctaatttttgtatttttagtagagatggggttccaccatattggccaggctggtcttgaactcctgacctcaggtgatccgcctgcctccacctcccgaagtgctgggattataggtatgagccactgcgttcagcctgaaatcatttgttctaataatttgtgtgtgtgtgcgtgtgcgtgtgttggtggattccttaggattttctagatatagaatcatgcaaatgaagacagttttccattttctttttcttccctaattgccgtgactagaacttccagtccactgttgaacagaagtggtgacattgggaattcttgtctttttcctgatctttgggggaaaatctttcaatctttcttcacttaacataatgttagctgttagctgtgggctttttgtagatgccatttatcaggttgagcctagctcctccattctacccttgcccctggattggcagtcctcctcccctttctgcagacagctgcccacagccggtccacggtccctacagcaccccaccctctcactctccactgcagggtgggcaggaggcagcacgggctgcgggaagaggctgaatgtagtcccaagaatgccaaccacttgtcatttgactccaaacaaatccctttgtgaaacttgatttcttcaatatacaattgtggaaaataatacctaattttcagaactgctgtgaaaaatttaaaaataaatttggttgtgtctggcacatagagggcattcaataaatgtgggttggatgtgaatctgagaagtgttcattgaaccttatctgaggcacctggaagtggccctggcactgtagagggacccaaggttcatggtggatgcgggctttctctccaagactgaccatccagaaatggtcctgtagcaaagtaaagctgcttggagtgaaatgaaccagccaggaatgaagatgtttaatgctccagaggttcagggaacctgcaggccaggaatgaagggggagaactgcatttcaggagtgttggagtccaagaaaaggagattagacttccctctatacccagcaggaaccactgaagggtgctgagcagttataagtggggtttgtgaagttagctccatggggagtggagcagggaggctggttccacagaccagaaatggtaaagacctgcactaggatgggaaggtaaggaatggagtagagagaacagatgtgagagacacattcattcattcattcattcattcattcattcactcactcaagtatttactgagctcatatcctgcttccctcatggaatttaccatgcacttcacataagtgcatatgaaattgtaattatgagaagtgcaagaaaggagagccatctggtggtggtgagcatttataaaggggcatacctgaactaatctgggaaagcaaaagtgctttcttgaaaaattgatgattgaactgagacccgaagggtgggtatttatccaggtaaagaggagatgaaagggcagcctaggcagagagcacagcctatgcaaaggcccagaggtgggatgcagtgtggtgagtccaaagcctgagggaaggccagggcagctggagtggatggagcatggttcagggtgaggctggcaggccgggcagggcagaatcaggggcaccataggctgcgtcaaggagttttgtccttcgcaaagaggaatgagaagctgtgggaggccttttagggtgggggcaggggtaacatgtacaaatgcatattttgaaagtttcactttggctgtcataagtaaaaagactaggatggagcataactccagaggaaaggggggaaagagttgaaaacagccaataacaaatgtcatccccgagctcttatgaaagacagacagtgttcccggggaacctgccagaggaagatgacttagagctgcagagagggaatgtggggagtccatgaagcagcagcagcagattcgaggcttttccagactccaaaaaaaccaggaggctatagctgcccagacagcaagggaataaaagatgcctgagaaggaggctctcggtcaaaggcaggcatgggcagtgggcccagagagtggatggggtggattcagggcccacctctcagttatgcacccagtacatggcaccaggtgctgagaccagaagccttggggtcatccttcccatccatgtggggtcaccccccacatcccaggtgtctgcaaactcatcaacaacccacagtgccttccaaatctggccgctttccaccctccacctggagtaccacagtagcctccaatctggaagcttccactcccctccactcagcctgatctccacactgcagccagactgatctatttaaaaccctcctgtggcatcttgtcacatttagaataagatccctgcctggcctggcccctggctggctcccacaggcatctcctgtccctgctctcagtcactcagttcctgccatgctggcctcttgctaccagccacaaacccaccaaacagacccccagcccacagcctcggcacttactctccctcagcctagaatgctgttcctggagaaatctccctgaccttcccgggccaccatcagcccctctagtcttcttttcccaccatggtctgtggtgcctacaacttgttcacaattccctgcactcccttggcatttttgtggtattcacctggcaaagcgccagccctggagaaatcccactgacagctttctccttctccatggctacccctgactgctgagccccctggtgagagtctccccacagtacgagggcagcccgtgccccatcagtccccaggatcatccaggccctctgcactgcacagaaactgcaggaaacgcctccccaccagctttgcctcctcctccagtctccgcaggcctgtggctccctcacacccctcctgtctctttcctgttgttttaaagaaaaataaaagtgagaaatctctcaaaatgtcccagcctcgggtcaaaccacagacctttcctcctgaccccttctcagttgagggcttttcctctggttaagccagttcccgctcctgcacaggatccctcctgacttctcaggaagtctttgccatccctgccctttcttgtgcctaacatttcccccttccctcggctgaggctggaccagtccagtttatcacatcacccaccaaaaatgagctccacctgctgccttgttctccctttccctttgtgaccacacacacacacacacacttgcgcacacacatacacacatgcacacacatacacacacgtgcacacacacacacatacacgcaacacatggtccccatttcatcacgtccgcctcactcatcagcccctccgttgtggcttctgccccatccctctgctgaagtagttctttgtaaagtcatggatgatgaacacaaggtcactaaacccaggccacattttcattttccttgagctggacccctgagctgtggtcaccagctggccgctgcctgctttcatcataactgtgactactcctccttcggttgcctcaggcttgcccttggggtccttcccttctcagccatggtgtctccctgagtggttccttccacaccctggcatcagtgccatcctcttcggtcagattcaagccacttctgagctccaggcccacaggtcaactggcccccgacatagccgcctgatctgggtctcctcttgctcacctccagtcagttccgtatttgccaccaaggcaatcttcataaaatgcaaagccggtcatgtcgccgtaatgaaaagccatcccagggagacaggccaaaagccctagcgtcgcctacagcccctcatgctctccatccagcagcacctcggctttccctccctgggttgctaacaccagcccatactccttcttttgtttcccctaatacactgtattaccctcctcggggcctttgcacatgctgtgcccccttcatggagctaaatcctatgatacagtttggatctgtgtccctgcccaaatctcgtgtcaaatggtaatccctgatgttggaggtgaggcctcgtgggaggtgattggatcacagggtcagatctagtgatagtgagttctcatgagactggtcatttaaaagtgtgtagcaccctccaacccccactcccctgcctcttcctcctgctctggccatgtgaagtgctggctccctcttcaccttccgccatgattgtaagtttcctgaggcctctccagaagccgagcagatgccagcatcatgcttcctgtacagcctgtggaacttcgaaccaaccaaacctcctttcttcataaattacccagtcttaggtgtttctttatagcagtgcaagatcagactaatacagtctacacatctttctcagctcaaacagcacttccaagtgcaccttcctccacacacccatggctccctcctcccctacccagcatcaaggccccaaccacctactttcccggctctccattctcatccccatggtactcatgcagcttgtgactgtataagcagccacctcatttgtcttgctcactgctgctgctctagtgcaggtgttggccaacagcagtccaggggctaaatccagtcccccacctaatttttgtaagtaaaattttgttgggacgctcacttgtttacacatttgttgttgttgttgttgagacggagtctcgctgtctgccaggctggagtacagtggcatgatcttggctcactgcaacctctgtctcccgggttcaagcgattctcctgcctcggtctcccaagtagctgggattacagttgcccaccaccacgcccagctaatttgctgtagttttgtacagaaggggtttcaccatgttggccaggctggtctcgaactcctgacctcaggtaatctgcccacattcaataaatatgtgggtctgtaaatgatcaagcaggaaagacttgagattgggtcacattatgtcatttcacagaagacactgaattctgtggggaagtggccttcctagggttcccccgtgcagtacaggctggctctgggcccggggctctttccacaaaccatgttaagactcagtcgtcatcaggctgtatccaggggcacccactcaagcatagattgggaaggaaccaaggcctggtgtgagagtgtgtgtgtgtgtgtgtgtgtgtgtgtgtgtgtgtgtgtacagtgagaccccaaagctggcatgggaggtaggggcattgcgcacagctttgggaactgcccacccttcctctcctcttgcagcaggcctaggactatagagagtcagacataccccgttatgaaccatttcacctcatgtggtttctttcacctctctgagtgtcagacttctaaactattggaatgcagcttttattcctaaaccctcgagttgaggctgggattaaatgagacgttgcatgggtggagaccacatgtccttcccacagcccacgtctacccagcatgtagagaaccactgcttatttttcccaggctgcccttgggttgcatttccattttccctgggagacatgccagtagctgagagaccaagattccctcggctgtctctccttctgatgtgaccccctatcacctggctctgctgtcccttgtagagtcagagaaaaaaaaatgtagaaagaaggaaaacagcaggagccctttcataccccacatgccacccccaagactcctggaggcccggagaagtgaagccagttgtccagggtcgcacaggcatttggtggaggaagaatctaaatccctggacccccagtccagtgcttccttccacagcccagcagcctcctccgcctccaggactatttcccccactctaggaggcagggctcccatggctgtggaggaatggcggtgagaacggtgtgagggagagccaaattatcgggaactcacagctgcctcgcctcccgcatggctgggagctgcagtccctgggagagcagccagctggaagactcaaggacgataaatggatctgggtgccagggctcccaggacagagtgaactcctctgtctggtcagaatcacccgagcaggaaagcatgaaatggcaccattaggtgaaggctgcagctgtccggggagggaggctgggggtgtggagagatgcctgctcccagcctgctgggccacaggtcaaggtctgaagaggaaggggcctgggaggccccaacaagggagaagacacacaagggaagggactgaggaagggtctctcaggcttggcctgcatcaagcccccctggggagtttgttaaaatgtagaccctctgccatcgcacctgtctcccagagcctaactcagaaaactcagtggactggaatgtgcccagggatctgcatggtaacaagcacccccatttcctctcatgcaggtgatctgggcaccacactttgaaaaaatgaggttctaagtaattcagaaattcttgccagagaggtcaaagtccaagcccagttgctggaagtaaaataagcctcagaggcactgcggacctggagggcatcaaggcagggcaggcaggaggacattggtggcaacaacaggttcaatcaccataactctgtttggtgagcacacagatgttctcatctaacccacctgggaggagggcacaattaccagcatcatttcaaagacaaggcaaattctgctcagacaggtcgtaagtgacctgcccaaggtcacacagttgatcagaataaagaaccgggtctaaatttgactgaggccaggtctcctgctcaggagcaaggtagggggcccagtcctcagggaaagctcaggaagggggagtctccaatagtgggaaatgatgctggagaagcaggggtggaccagaagcaaggtcactaaacagaatccacgcaggaattcccttctctccctggtccactggccactgtccttctgtctgcccaggatggccacttggcccctgtgacagtgtcagtcccaagcactcaggcctctgcaagtggccccaaggctgggagcaatgggtccaggaggaaccatgcttggcatgcatatcccagcacagaccctagaacatgcctgggtctcggagtgctagttaactgcctctggccccctttgctggggagaacagccacatttggcctgggttgggtgaggagttggggagcaggtgacaacctggttggcttatcctttatcttatccttttctttctatcatgtagagagctgtcagggcagaaagcaggacttcaggtgagtatcaaaaagaatgctctcaacagagagcctagggatacaccaggatggggagtgcagggggaaggggccaccatctctccccctattatgagccctcttataacaagcagaaacagcatgtctagaggctctctctttccttaactccaaatgcccagatgtgctcagagctcagccacagttcttgtacctaaactaaagagagacttgattgacaatcaagttgagtaggagggaaggggagctaggctggaggaggaaggtggggtgagacgacctcacacactcaccctcacactctcagtagttctgggatgttctgctttgagggtctttactctgcccatggtcagcccacgtgggagaatcacagaagacccagatgccctggagctttgctctgtgtgggtgaacagggaatgatctccaagggagatagtggaagaatcagtgtgcaggggagtgagcaagatacctgtgtaaaagggtgggggagaagcatatgtatgcttgtatgcttctatattcacagcacggctctggaaaagtgcataaggaatcgatgacattagctgtagttgcttttggggagcagagttgggaaagcaggagctggaaaatatttcactgggtatctttctgtatctttaaaattttgaagcccatgaaaatctgcctgtctcttccaccctctggtacttcagaaccctggagctggatcctcagccttgagaaggagaaaacaaacgaggggggtttgtgtgtttttaaatttatttaattttattttattttttacagacagcgtctcactcccttgctcaggctggaatacagaggcgtgatcatagctcactgcagccttcaaactcctgggcccaagcaatcctcccacctcagcctcccaaggagctaggaccacacacatgcatcaccatgcctggctagttttaaaattttttgtagagacagggtaccactatgttgctcaggctggtcttgaactcctggcctcatgcgatcttgccgccttgacctcccaaagtgctgggattataggcatgagccactgcgcccggccaaaagagagaacaaatgagtgggtttgtgtagctcacccggaaatcgcctgacctgctccaggtgggaggcatgctgcagggagaatgccaccaggacctgcccccctcaccctcagaggacacctggactctcactttgcctcttcttccctacaaaaagtcgggagactagaagccctgttgtctcctctagcaggcttctgggattcccttggtgtgcccccaaatgagactgcctccaaaatgggatcctgatgccacatcaaagatgagtaagttcgatcctcaccctcaccaaaagcatatgtgtgtgtgtgtgcacacatgtacacacactcaccatcaactgccaccccaaatcaattaaatatgatctggggactaggcacttctgtggattatcccactcagtactggcctcgattaatgcagataatggagagctgactggatacagcttacagtatttaatctttcccggcattgtatttgcagaagccaaagtaatgagatggaaataggttaaccagcaagacacctgtcgccgaagctcgtaggctaaaaagatcaatacttaaggagaaatgtttgtctttatgttttgcaccagtgcttcagtccaacatttggtcctgggaggctgaggataaagtgttaatgaattaattttctagctcattctgaaaataaattacccatttctttgagttccttgtgtaccgaggtctgatgagccttcttggtcagtccacgcacacctccactttggagcaaggttgtcattctgcacacatagaagcagagtctgttcttgactggccctggggaagctaacaactcccaggttcctgagagttggaacgtccttctagtgtctaacttcaatctctcctgctgcggcaacactcattttccttctcttgcatctatgctgagatcagcaatcccaggccacctgatgggcacctcagaatccaatggctgaggattgagcccttcctgcatcaatcttgggctggcctgttagcctccctgcgcttgtgcagctgtgtgtgagggttaagcatccctgccctccctgccttaaggactgcttccatgatcaaaggtgaagtttcctgagtaaggctctgcaaatctgcagcacctcacgcctgcctcggattatttctctctgaacctagaccccaggcatggatacccttaaatcacagacaaatattaataaaacccagcctgtgagggctgaaggactcttacagacaatgcagtccacagcctcttttcgaaaacaaagaaatcgaggccccaaagggaggtggcttacctccatcacacaaacaacaccactaaatggtggcagaactgcctgagttgtcaattcctggattccaggcctttgtagctcctcaggccaccccaccaagccctggctccatttgatccttggctaactcttgtagggtgtaggggtagcggtggtgagggggcagagggatgccctggccaggcaggcccctcagcacaccctccgctctgccaccccagccaggatcaacttgaaacagcacagaggagcccgccatccccgtgggagagaagctggagtccaggctccctggagagggagttaatactgcagcacggcgcactctagccaaggcggagaagctgctgagtcacagtccagctgcctggccagccctgagctgcctgctggggcccccagctgctctcagcccagggggctgcctctggcccccagacaggctgccttcccacctccttctccagagactcagcatcttgggcctccagggttccccactccccagcaccccacaacatctcccaaacccacaggcagctgtcctggggcggaggagagggtcttccattggttgagtgtcaagatgcttgggagcacgccaggaagggtgggggaccccgaatgagtgattgagtggggacagatggaggcttggggaccagtgggccctgggctgcctggtgtaggatacggaaagtgtgtgtgtgtgggggtgcacccgtgggccccaggaggtctgttgtgcgcatgctctgagtgtgagggaggacgggtaggaccgtgggggtctgccctggtcgtgctcccaagagaggcactgctttctgcagagcgcgtgggcaactgtcagctggggaagcgctcaccaggggaaaggggagctctctgtggcttagcagtgattaacccacacaatcaatggatcctccagccacagtgtgagcagctctgcctcatgtgaggcacacagcaccttccagcacagtcccgatatctttcatgccagatgcacatcttcaatttcagctacaaaccattacaaattgatgcattttctttctgactaaatgttacaaggtttgaacatactatctctgccgatcaccgcccctctaagggatgggtttagaggtttggcacgaaagcaaaagccttttaataggagtgcgtgagtgtggtggtgtgtgtgtgatgtgagtgtgcatatgtggtgtgtgtacgtgtgtggtgggtaggggtatacgtggtggtgtgtgtgtgtaggatgtgtgtgctgtatgtgtagtgtgtaatgtgggctctagggtgtgggggacagtggggtgtgtgtatatggtgtgtgtgtgtgatgtagggggtggtgtgggttaggggtggaggctctagtggggtgtcagggggtatgtgggtagtggtgggtagtggcatatgtgtggtgtgtacatatgtgtggtatgggggtatagtgagtttgtgtgggatgtgtgtgtcagtgcatctgtggtgtgtgtaatatgtgtatgtgttgtgtgttgtgtgtagtgaggtatgtgtgcagtgtgtagtagggtgtgtgtggtgtgtgtgtggtgtgtgttgtgtggtgcatgtagtgtgtagtagggtgtgtatgtgtggtgtgtgcatgtggtgtgtgtggtgtgtagtaaggtgtgtacggtgtgtctgtgtggtgtgtagtagagtgtggatgtgtgtgtggtgtgtgtggtgtttagtagtatgtggggtgtgtagtggggtgtgtgtgatgtgtgtggtgtgtgtgtggcatgtagtagggtgtgtgtgtggtgtgtgtctgtgtggtgtgtgtggcatgtagtagggtgtgtgtgtgatgtgtgtggtgtgtgtgtggcatgtagtagggtgtgtgtgtggtgtgtgtctgtgtggtgtgtgtggcatgtagtagggtgtgtgatgtttgtggtgtgtggtatgtgtgtggtgtgtgtctgtgtggtgtgtgtggtgtgtagtagggtgtgtgtgtggcgtggactgggggtgtaaggggagggggtgttgccagtgtgcggggagggggaagggagcaggggcaggagcccgggctgggtggcaggtgcccccgctcaagctgcgggagagtagctggagagaccgcagcctcctccccagcctggaggcccggctcctcccttcctgtggcccggcgaggagacctagtggtgccccctgctgtccgtccaggagcctgccgcctgcctccagccccatctccacccaagccaggcccatgccctccgcacacagccgcacccccgccaggctcactgcctcccaggcccccagtcaacgctcacaccctggaaaggaggaggtgggcaaccggtgggaggccggaggcagaaggaggctccatcaacccagtaatggagcagaacatcagcactgtggcatctgctagccggcagcaccggggtgggggtcctgtctccatctctcaggcccagctgaaatgggtgacagcagccagtgcagggacgtggcagagaatgccagaaaggctgtgtatgtgtatgtgggtgcacgtgagcgccatgtgtatgaacaccatgtatgaatgtataaacatgcatgaaccggcactgtgaacatgcatacaaacattgcgtgcaggtgcattacactgccacatgtagaaatgtgagaagccccagggaagggagggctgggggtctggggccacaggacttgtcccggaagctggggtgatagctacaggccccgtacttgggtaatgggagggggtggactacggtgcaggtcaccttacagcctcggggttggaagagaccacagggtcaccagcccccaccctccctctgcagcggcaactcttgccagaccctctgtctccaaaggtggcaagaggtctgggacctgaaagaggcatcaggagacctggtttctctccacttctttccatcctttggaaagtggctttgcatctcccaagatagcctctcagctttcattttttttttttttttgagacagggtctcactctgtcacccaggctggagagcagtggcgcaatcacagctcactgcagcctcgacccccacgagtagctgggactacaggcgcaccaccatgcccggctcttttttgtagagaaggtgtctcgctatgttgcccaggatggtctcaaactcctgggctcaagcaattcacctgcctcagcctcccaaagggctgagattacaggcctgagccaccgcatgcggcctagatagcctctcagcttttagaaccgagccttccgagatgcttggagagttctacctctgaaggcgagcgggcacaaagagtagtggggtcatgagagaacttgggctttagaacagccagggctgctttccaacctgacacttagcagctctgcagccctgggagatgagttcatttccctgggatcatttcttagctacaaaccgaggatcaggtgcctgtctcacagggatgttatgaggattgaagaggccacatgtgctggcacaaagtggtccctaaataaatactcatttcctttcctcagttctcctctcagcggggctaggccgagtccatgctgaccatggactcaaggacggaccttgtgttacccacaacgaggggtgcagtgctcgccaagtcagggactctgagccagccccggctctgtccaggagggcaagggttgctgcagaggttgtgcggctggggagcctgaggcccagaattctcttccctggctctgtgtgttcctcttgcagagactgcgtcacttcttcctggtgtcaaaggtacttgtataagcagctcagctcctggaggatcactaaggctgtgaggtgggaacgtgtcttgttcacgactgcatttcctgccagctcccagaggagcagcctgattgctgagcctggtagcaggcaatggaggaggtgggggatctcagcaggcactgcccccccaactctggcaacctctgtcccatcaagctccctgctaaaggagagaagagaaaccccaaagccgaaagaggcaccctgtctagttcagaccctgacacccagggcctgagtggtcatgggtggggtgtggatgggcaggcgcactgccttgcggtgctccactataggtaggcaggcccgtggctccccatggggaaagaaggtccagtgcagctcaggttctctggagagtcatgcgcgaaggaagggcatgaagaccacttccccagttaatgagggtttggccaggagttgtctgccttacccaaccttgaaaataacccctagcatgtttaattgcttaaaaatccactctttcctctgatcttcactttcgttttctccaaatcctatgtcaggctccgtgctaagtgctgggaatacaagaagaataaaacccaaccccatcctgaagcagctcacggggagacaacagagctcaggcctttgggaggtgcagcagatgtggttctgccccttgacagaggagacagctaaggctcagagatcagcttgcccaaggcctcccggtgcacttgaaccctgacttcctagcactcagcccagggctctttccttcccaacaaacagccccagggagctcctgaagcacactgggaaggtgggtctaacgggaagaccacaaaggcaccgggctcagaggtgggtgccgggggcagggagggagacctccactgtgcccactccgttccagcggtgtatttcatttcatccgggccctgtgaggtggggactgtgattcccattttgtaattgaggaaactgggcctcaggcggagcgaaacaggtcgctcgctcacagcaccctttcccagaggacggaaacagctgtactcccaggcagcagagtagctcgctttgggccacaccgggacctgggagaggtcatgagacgtctggagagcccagcctgctctcagtgggagctgggagccagccaaggaaggtgcagtctggtcctcccgtttccaagagcgcctccgtccttccagatgctggccaggcgccagggacagagatgtacccatcactcttcagacagagatgcccattatcaccaacacctatgacagctcgtggtctccagaaactaaagtggagcatgcaagtcccgggggcacaattaggtgctccaaagaagccagctctctcctgcctgaccgggagccgggacagacatgggaggtaggggccaggagggatgaaccatggcctcaaaacacccatgggctggaggaggggagcaatgagggggagaattccaaattggaaagcctcaacttggaattctatgtggatccaaacctagaagacagctctgctgaggaagaggagccaagtgaaacaccaggtgcagccaagtggggtgaattagcacctgggctctggacagactgacctggactggagtctcagctctgtcacttttagccatgggaacttgagcaggttgcttaacctctcttggcctcagcactccatctgcataacgggaatgataatggaagctgctgtgcagtgctgcgaggcttaggagcactgtatgtaaagcatggcattatgtccatggctggttcctgagccaggctgggcacaggcctgtcagaagcacacggggatggctccagtggagaggtggggcagcctctctgctaaccccctattaagggccagattaagccacccctttttaaaatttcctgggataattcaggcctctcttaatcaatggtcctccttctacccatgcctttagctccagcccagacggccttcttgatgcccacctctgggccaagtcctctcttctgagccactgcactatccctggcttctttcctgcccctgtgtccagatcctgccaagcctttccccgtcctccagcccaccttccccaatactcaggcctctcagcagccatggcttctccaaccgtggctgctgagtctctattttggttgctctaattttcaagttctcatttgtgggtatctgaccacatcctcctctcagaagtcagcagagtctagctgttcttcctctagctgccactcccatcctatagatgacaacactgggatgtgaagaggtgaggttgcccagactccccaaggatgtcccaggcaaaacctatccctagtgtggtggctcatgcctgtaatcccagcactttgggaggttgaggccagcctggacagcacagtgaaaccccatctctacaaaaaattttaaaattagccaggcatggtagtgcatgcctgtcgtcccagctactcaggaggctaaggtgggagaatcactggagcccaggagtttgacattaggtgagacctagccatgccagcagaccagccaagcggccatacccagcaggcagcttggaggggaggggcaggtgtgttgctcagaagtgactctggaagtcactagcacaaaagaataatccgctggggagagtgtgggcataagaagaaatccagagatgggcttctagaaatatcagcatttggaggatttgtagagaaagaggaaagccagggagattgaggaatgaccaggaatcggaggaaagctctgaagaacagaaaatgactccatggcaatagagcggttacaccggaggggcaggcaggggctgggaggggacagggatccttctggggaatttctttggtgattatactggtgcatatatccataagttgtgcactttgctgaatctaagttataacttcatcaaaaagaaaaacgaatgtgcagagcagaaagagctaggggtggacccctggctcccacacactctggcttgaccaggtgctggaggacaccatgggtagagagagcatagaccctaatagagcgccgtgcatcccatcgccaaccggctttcccatgatgcacaggcgcttctgctgagaaccacagggcaaaggcacctagaaccagggagccactgaggaaaggcttcctggaaaagcagcagggagccaaggtttaggaggagatggggtgggcttggaagaggctggccagtttccaggcaagagacgtccacctgggtgggtgtctggcaaccacagaccatgatgggacccctcacagccaccaccctggaaagcgcagcgatgacagctgacttgggaaggtgatgacacggcagaacacaccccggctccagagacgccatcatctgggaccctctccacagagcctgacttagggcaggagagcctccctggtccaggacaccagaggcctcaaggttttccctcacaggagcctctttccacacccccggccccagcaaacatttgagaatgggccgttgccctgcctagcagtacacagggctctggcctccctgctctgggccagaggagaggggaaatggaattgggcagaggactgtcccttcatatgaccactggtgacaaacactgtgtcctgcagagcacggcccaggatgaagcacctccacccacacacatggcattcggcagctgcagggcccagccctgcaccatttctgaaggtccacacatagcacatatcacagctgaggaaactgacagccagagagaggaagggacttgtccgaagtgacagagtaagaagcctgccttactgtgctcttccaagctggcttggaatccagtgctcttccaagtgctcttccaagcttggaatccagtgctcttccaaatcatccagtgctcttccaaactggcaaaatcctgagcctcggagaggcttactgagctccctgcctaccaaagccagcatgggtgagcatctgtggctctctggaaccgcagggagttccagtcaccctgctgatgacccctgcttggagctataactataagtggaatacctggggtggctcctattagaccctgactccctggagctggcaacagagaaccagcatgtaacagtccccacagacggagctagcctgcatcagggtttctaatgttctgctgcaggttcacttcgcacttgagaaggaggaacgacttcagtttttttctagcagcttcttggctcttcccagtggcccctcccccaagcaaagtcccctgagaggaaaaaatcacaccacatctttgtggatcagtggtgcctctgcccccacccaagacaccgggcatgtttcctcatgaagagtgacttgcggctccttcgcagcactgagggctggagccagaagaaggatgaacccactgcgggggtcttctctcttcatgttggaaaacagatttaggctcaaaatgaaggagggtttttgcacagtcagcaccacccattgatgagttcgtggtcccaggaggtaatgagtgctccatcatcgggagcattcaagctgaggttagcccactattgggagggatattatagacaggactcaggtaaggggacacagcattgacctagatgaaatttgaggtcccccttccaaccctgagagcctctaaatctctgacatctccatcccagcccttgctgccaattggcctcatttgcctggccctgctggtttgccaggcagtttgtcctcagagagaagtagctgccaattatgtggggaccacaagagtttcctttatgacatcaccactctgcaggaaggggctgaggtggggtaagagaggagaaacaagacagaaggtggtaccagagaaggagtcagctccccagggcctggaatctgcagtgttgccaccactaggtaatttgtggggcacactgctgttggggtctcaggaagccaagtctgggcccagaagggaaatagcccagttctggcctcctgactggggtgggggactgtcaagggaaaaataagcccaggctagctctctgaggctcattagagaaaaaggtaaatgtcgaagacgtgtcatggcaggcagctcattaagcccacggagcttaaaaatagtgagacacacagatattgggggatggggagctggggatgagacgccggctcatcacactgcagggaagaacagcaaacctgggagaaagtgactctataaccagtggaagaaaggctgtgtagccatcaccggatctctgggtaagcttggcgcacagggctgctggaaatgtcagaccctgttctgtcgatgagaagactaagcccagaggagggtgttcccaggcattacccaacaggctcgactgttctccatgcaggggaagagagaagacacagagacacagacctgccccggaggaatccagagcccacctgcccagagaggctccacctgatttccctggctctgggcacccccttaaaagccctttatgccatctttcctttcagtcgagtgatgcaggatttgggaccagacagcctttgctcaaatccttccacagttatctaccagcttggtggccttggagaagttatttccctgttctggatgtgcttcctcttctataaactagagacactacaaattcccaccacagaggggtaaatgcagcatcctgtacgttatgtgtttggcacaggacctgggatgcaggaggcactctgaccggtggcatccaggaagtaaggaatatggactaaagggagggccaaggaaaagtttacaggctgtggctgtgcagttggaagatgcagaagcgcctcgctgggtgctgccaggttaggtttgcagaatgcagtgaatgctcttgctgacaaaggatggggataagtgaactgggtaatcatgacctaggggaagccactagctcaaatactgatccctatttaagtcaccaaaatatgctgggcacccagtgggtgcccagcgctttcccataagtgatcccaaaccaggagctagtccaagcctccaaaggtggctgggtagttcattggaatgagggctgcagtgactccagagggagcaggactccagaggagcaggactcaagagaaggggagccagggaagactgaggggatgtgtaggtgaggtggctcttttctggctgagagaagagaaggtccccagcccacaccaagggctccataatggaagggaggcctagggtgggtcctccccctccccatcttcatcccactcagcccctacctggcctttaacacactgggtgggagaagtgttgctgagcacagcagtgacctgaggccctgggcactcatcccagtttagctccacaggggactccagttgctgaggaagaatatagaacttatataggatgggggagctggaaggaaacttaggatcaattgttccagcctctaattgaatggtggggaaacccagagacagagaaaggaaattactaccccttccaagccagtgagagagccagatctagaatccagggctctttccatgatattgcacctcccatctcagtcctgtctttatgaaatgccatattgaagctttatgtattggggaaatttaactgaggctcaaacggacacaaattccctaaagccacatggtgagtcagacagcgaaatgcaaggtgtctggtcctttcccagcatccaacgaacgtttcttgggcacctactacagtcaggctgggagcactttcagacgttctctcacttaaatctcacatgtgggagcaagttggtggaagagcgaagggccagaggccagggtccaaatcctggctctcttagctgagtctccttggacaaatcccttgatgtccctcaaatgatgcctccatttcttcactttataagaaggggattcataatagtacctaccttgtagagtattatgataattaaaggagactatccatatgaaatacttagaacagagcctagtaatataaatataccatttaaaaataagtatactggctgagtgtggtgggtcacacctgtaattccagcactttgggaggcccaggcgggtggatcacctgatgtcaggagttcgagaccagactgaccaacacggagaaaccccgtctctactaaaaatacaaaattagctgggtgtggtggtgcatgcctgtaaccccagctacttgggaggctgaggcaggagaatcacttgaacccaggaggcggaggttgcagtgagccgagattgtgccattgcactccagcctgggcaacaagagtgaaactccatctcaaaaaaaaaaaaaaaaaaaagtataccatttgacaatcctaggcatatacccaagagaaatgaaaacacgtatccttacgaaaacccttccacaaatgttgatagcggcattattcagagtagctgaaaagtggaatcaaccaaatgtccatcaactgatgaatggagaaataaaatgcagtatatccacacaatggaatgttatttggcaataaaaagaaataaagtaccgatacatgcttcaatgtggctaaaccttgaaagcattatgtgagtgaaggaagccaggcaccaaagaccatgtgttatataattccatctaaataaaatatccagaaggtgcaatttcatagagacagaaagtagatgattagttggctaaggctgggaggaatggaagaatcgagggtgactgttaatatgtatggagttcctttttaggggtgaaaaaatgttctgaaattagatcgtggtgatggttgtgcaattctgtgaatatattaaaagctattgaatcgtgcccttaaatgggtgaattgtatagtatgtgaattatagctcaataaagctgttttcaaaaagtaaatatatatttataaacttctataagatagtaaatcatatccattccaatttaatgataaggctcagagccagtcagcaacttgcccaaagtcccatgcctaggaggccgcaggacctgattttggactttgtgttgtcgaactcctgaagctcctaagacctgatccagttcagactcatggagagcaggcctgcccttatgtatcttggggaaagcctccattccctgtcccaatgaggccactcaggaagttctccccgctctctaatccaaacccatacaacttacaagggatgatattcagggggatatgaggtcaggagcagggtcacaggagacaggcaccagaagggaaagctacatttctaggcaatgctggatatcttctttagggaagcctggggaatggggcagatgaaatatagtggacttcaagacatgagctcacggttgattttgggggtgaccttggccaagaaacctcatctctggggctcttggtaaaatgatattcaggaagaagctctgaggacagctccagaagcagacatttctaaggctatttataaagtggccttccctctccttacacacaactcaccccagatgatcaggtgggaagtctgtagggcagtgggcatcacttggttgcttgcttgggtatatacaacctggtcacccccatggttcttggcagaagatattggggccaaaccaagaggccctaacctaaccatcactccaatactgtgagcaggtcaggttggctctccctcccagccaggaaggaggaaagagaaggaagcgacaagggcactaacaaccagggtccttgtcttacctggcaggaaagatgctgaatgtgatattgactcaatgtgctgcttctgatcagccccctgcctgcctccctgcacagtggatagtctggctgcaagtggtagggggaaggagctcccacttttgacaacccaggaaaggcatcacctcagtttgtctggagctcatggccagggtgtcccagcttgaaggagaggttctcctgcccccttctctgcttgtacaactatacactgcattcagaaacactccttctcccttgctaaggagcattaggagatacaaaaccaccatcctttttccaggtgaaataaggaagaacagaaaatgaggagggccagattcagcccagagccacccagagtccaagtggcctcactgggagagcagtacactgggtttggtgcccttggtagaaagcccaacatgccaggacctcagccagcaagccagcatgtgctccagagcagggacagggagaggccaacctgtgcatccgctaggctcactggctatttcagaccatcatctgcctcattcgatcccaggacatcttgggagaagtgaggaaggcaggcatccctctccacattttttaatggggaccactgaggtccaagagatagggaaaaaccgcttgcctggggccatgtgcagtaacttaatagtgggttcactggattctagattcttctcatcaaagccaatcatacccctgcctcgccccactcccagctctgctgctatgtttctttacctacaaaacgtcagtcagttttcagaaacaccataataacactctttatagcactttatggcaaaatctttatagcaccgtgtgtcaggcactgcctattcttagagctatatgtaaatagtcatacatcaaatcctcatgccaacctgatggcaagctatttcatttccattttacagatgaggaaactgaggtaacaagtgtttaagtaacttagccaaagtcccacagataaaaaactggaggagctggcatttgaatacaggcaacctagccctagcatctgaggtttaaccactgcaccacagtgccaagcacatacaagtacaaggcttcgcatattccaagtctcactaaaacatggactaggggctgggcatggtggttcacgcctgtaatcccagcactttttgaaggctgaggtaggaggattgcttgagcccaggagttcgagcccagcctgggcaacatggtgaaaccctgtctctaccaaaacaacaacaacaacaaaacaaaaacaaaaacaaagaaaaaccttgcaaaacaaaaattatccaggcacggtggtgcatacctgtagtccccgctatgtgggatgctgaggtgggaggatcacctgagcctcgggaggttgaggctgcagtgagccgtgatcacaccactgcacttcagcctgggtgacagagtgagaccctgtcttaaaaaacctgaaaaccaaaaccaaaaccatggactaggggcacacgactaggctcaggacgaagtgtgtgtgcaggaagtccacataagtccagaagctgggctgtgctctcacccaggtgccatgtgctgggggcggggatgggggacaggctgcaatttgtctctgagcagccagctgccctcaagtcccagcccagccgagcagtggggagcaggttgaaggcaggcttggagctggcaggctccgtctgccccactgtgagcagcagctttgagacactctcctgccggctgctggtaggtgctgcagtatctctcctggctgcagggctggctgggctgaggccaggccaagggccttccttccccctttcaccctctgcccctccctcagtgcccggggccaaacgaagggcttaggaagctactctggctttctggtctccaaggactgccggccctgatgattaatttggtggctgtgggactaggtttagtcttgggtggcagcactgacctccaggaatgtcactgtggccccttcaggggcaggtaacaaacctggctcattcccaagagagtaagtgagtccggtggatcaactcccacggttttccacctagcatatttgccaacagcgggcaattcccaggtaggaagtccttccttgtacctcacatgagcccttcctgctgcagtatagccacattaccttctactagaaacccttctgcttccaaatgcaccctttgttaaattgctaagatgtgattccatgagcaacacagcaatcacaaaagccattgaagcagacggcagctgctacagggttcaagcattccattccagctggggaaaggctgtgggctttgcccctccttccccccccagcccctccccaatctcaggacacagagaaaagaggagcaacatgcggagaagaaaaatggaaaggtaacaaagcaaaggcagaaaaaaaattcacagcctcccttgacctgccaaggacttcttccacatctttccctaggcttgggggcccagataaggaactgagactttcttttttttttttttaattttattattatactttaagttttagggtacatgtgcacaatgtgcaggtttgttacatatgtatacatgtgccatgttggtgtgctgcacccattaactcatcatttagcattaggtatatctcctaatgctatccctccccctccccccaccccacaacagtccccggtgtgtgatgttccccttcctgtgtccatgtgttctcattgttcaattcccacctatgagtgagaacatgcagtgtttgtttttttgtccttgagatagtttgctgagaatgatggtttccaatttcatccatgtccctacaaaggacatgaactaatcactttttatggctgcatagtattccatggtgtatatgtgccacattttcttcatccagtctatcgttgttggacatttgggttggttccaagtctttgctattgtgaatattgccgctataaacatacgtgtgcatgtgtctttatagcagcatgatttataatcctttgggtatatacacagcctttcttgcagcttctgcagcctctgcctgagagatccgctcaatgggccatctgctcggaggcctttctgcaaaagctttaagagttccatttctccagggagctggaagctggggaggtgtcagctccaaacaataagggaagtttattagggatcagggtttccaggaggatggtgcctgctaatggggctggatgcactctgaggtacaaagggttatttaatgcggaaaatccaaaagctcctttagaagtcaagtgctcacacccgaggccctacacactgcagccttccttttcactcaaaaaacctgaaaaccaaaaccaaaaaccatggactaggggcacacgagtcagctcaggactgccaacagcgggcaattccctggtaggaagtccttccttgcacctcacatgagcccttcctgctgcagtatagccacattaccatctactagaaacccttctgcttccaaatgcaccctttgttaaattgctaagttgtgattccatgagcaacacggcaatcacaaaagccccatcaccctaccctgtttgcccctaccccgccccatcccaagtcacacttattccctgtcctttgctactgggcaaatattgactttctttcactcagccttgtcaatggaagtgagaccaatggggctggctattgtctccctcctctctcctgtcagagggcaaagcaagctgtcagcctcaacagcgggagcagggccaactgagacaagctgagaaagaaaagtgtggtcttggaagtaatatttctgtcttttggtcttttgtctttctgtcctccctcccttccccaagcccatctgggtttatttttttcacatttggctatcctgctgccctgtctggctcaagagcagcagcgtggcatagctggcataactgagagagctcaggcctgggaattcaagtgtctgatactgggtcaccttatgctagttctttaattttcttgggcttccatgttctagtctgcaaaatgggaaggttggaccccatgatctcagtatctagatcaggaagttccttcctatcaggacccatgtcctttctgctgcagtcaaggcattttaccttgtgctctgatttcagaaaaaatggaaaataactgcttggtgcttaacagggaggaaggaaagagcgttgcattgaggttctacaagggctggcaagctccatcgctggtactaacatgctgtgtgatcctgggcaaggagctccccctctctaagcctcagtttccccataatcaaaacagagggctggatgagatgatcccacagcccctttcagtgcctcgtcctgccgtggcactcatctaacacatccctgcggaaggcgatgtcccccgctccttcagcttttctccaaggcagcatctcacagcctttcctcatgactaaccttgaatggagggatgccatgccgctggctcgtgttccttcatcatcaggagccttttgtcagccacactcctctcagactcatgcttgcttggcctttggcctttgtggctgagctcttcctttctccaggtcccatgatgaagaccagagcatgcaaactcctggagcctgcggccagtgcacagcaggaggacgacacaggacattggggcattttgggggattgtgtgcatggtgacaactgcaggactgtgaactgtatccctgctcttcctctaacttgagccctctctgtgataacacagaacctcaaaaacccattccttgtgcattagtcagtatcacactatggacttcctattccaggttggcaatattcccttttcacagatgagacaattgaggctcagagaggttggtaatttgcctgaattcacacagatattaaggagcgagccaagatgggaacctagatgtatctatctgcaaagactttgctcttaaccgtcagcgctcttactgagaaggggaggtcatcgcctctccccaagctgacttacaggactggaatcacagggcagtgaacacccaaagcctgaatgactccaacaaacctcccaccccctccacccccacccagcctcggcaaaagcagagccagcagggtcgtggatcaacaaagccagaaggactttgggtcatctaaaccaagctttcacttcacatacaagaaaactgaggtccacagtggcgtgcgacttgcctaaggtcacacagcaagtctagggtaaacctcggtcccggccatggggtcctgggagtccccctccaggttgagccagtccctttgccactccttccacctgggtgtagacatgccttcagccactcactccagggacatctggccttacccctctctgcttctcagttggtcccttcctagaaggttcggggaatggagtaaaaggcccattttatcataaccagaggtgtggcagagagtggggaagggagaaccaaaggaaaacaggtgtgagattattggaaagtcaagcagtctctctgtttcccatgaagtttctaatgcagaatggtcctaatgatcagagagagagagagagagacagagagatagtgctgatgttcccattttgtagggaagctttgaagatggtaggggaagatcacactgcaaatctacaatctttccctgctccccatggccactgctcacagctgccctgccacctgcttgctacacagcttgtattattattattaacaatagctaccactcactaaggacttagctcagtactggaccaagtatttacatatgcttcttgtttaatcctcataaaaaccctaaaataccaccactattctcattttgttttgactacttagtaactgaagctctaagatataaagtaatttgctcaaggtcacacagctaataaccagtagagccaaggtctcctggggactccctccaggggtgtgccgggctttgaaattcatatactgtatttgtctcaagttgtcttgactctggtgacagaagtgggagggcaatgcattgggaattcctggagaccacctgctcccatcacccagccaagcccacttcctgctactcagacaccagcccagaactgcagccacagaattgtggggttgcaagggcctgagaagttaactagttctaccttctcaatgtacaggggaggaaagcaagaaagggccttgcccaaggtcacacaaggtcacaaaattggaggcagagcctgtaaattaaactcagctctcttgtctcaaactcggactcgtccgcaacaccctaatgcccagtatgaagttattgtctcatctcaactgaagacagaaccagagttcatcccaaaaaggagttagattagactttcctatggcaaggactgtcacattgcacagtggggtgctctaggctattgtagtggagatctttctaaaacgagacaattccttcagatcttccttatctgagatgaatgcagccctgtctggaggtagagagcagacagcatgaccttgtgaggtccttgacatcaccctttaacctatggtcatctgtctgtcacagcgaacctttccctaggaaagaatctgccctctgcaaagaggatgtgtaatgctggaaagcccgcctttctccccatcagctggattctgagagttgggagagatgaccaatgaacaggctgagggtgtcacagccctgctactttgggatggggggtgcagtaggggagctacagtcttcccagaggccaggtcattctacccagctgcaccccatccccaacctttcagtgggcgacacctgcagggtgttgggactgggagaaacctcagataccttaaattccaaaccccattttccagatgaagatactgaggcccagagtgggtcagtgagttgcccaaggtcataggacaggtcagaatggaagctttccgactctccccggggcgctgggttcacagctccaccttgccaccccctgccccggaagtgagcactgaagtcacttaagagaggccagtgaccaaaggcagcgattcccaggtgcagaggctggggcagacgtgcccatgagcttgttcccccgcgcaccctcccccacctcgtccccattcctgtcttggttaccatgtgcctccatcatcctgagattcagagaggtgcagcggcttgtcgaaggtcacacagcacactgagtagggccctcgtttccactgcccagctgccccctcccattgcccacccgggcctctgcaagcttgccaggatccccgggagcctgcttcctccaatgcacagagccgtggcgcgtgtcaaagtgtgggaaagttcctgggagagggaaggggtagaaaatacagccgctcatctcaaccttggacggctgcggcaaggcaggggcgctcagaaaggcagccagtcctgcgcaccgccagtgcctccggcacaccccactctgcgccaggggctccccagggtcgcgcgagcatgttcttccagctcctcctcagcgaagcaggcgcggcggggtcccacgcgcccagcacccacttctctccgcacgcccacttcatgcacctccccgcgcccttcccacggcttctctgcggcgagtcgcctttgcttccccgcaggtccccggtcccagcgctaaggcaccgcggcttctctcgccttctctccgcgttgaacccgggctctccgcggggagaaataggttgggggcgaggggttcccgagataattcaggacacctccccggggtctagccaggtaattccgacgcccatggatttccggattacagttcccaccgcgggctcagtcctactcttagtttatcccgcggtgagcgccaagccccaaaagtcggagtgtcaccgtttggtgaccccgcgtccgcccgcgcctcaggccctggaggtggccactgtcggtccaggcacggcttcgctcgggactactggctgccctcgtggggtgccccgcctggggttccctcttaccctgggacgttccaggcgcgttcagcctgagctggtggagagggcgggggcgggggcggctggggtcccgaagtccaggtccctcttcccacttccccgccggccctgccgctgcggccctcgctcccgcgctcgctcgctctcgagtctctccctctctctcttctcttcctctctctctctctgcagtagtaacaacctgatcccgcttcccccacccgcctcttgagatgctcctcacatccgcctgcacacagcgcgtgcggcccctccgaaggcgatccccgcaaaccgcgacgcaggtcctccgccccaggcaatccccgctgcgggagaggccgcctcctggcgcccacgccccccttctgcagtccgtactgccggccgagggggaaatgggcgacaggggaaggggaggtgtgtgcgggacggactaggctggggcagaggggtttaaactggcgcggtcctacagaagtttgaggagggcggggccggctccgagcccccggagccctacgggactcccccgattctactgaggagtccccgccagctccgtgcactcctgcaacactccccaccccacccgccagctccgagtttacagcctctcgggtccggggattggctgggggaggggacgggggggaggggaccccctggctgtagggaacggcgtgcgggcgggggtgggagggaaacgatttgcttcaggagatagggatgaaggttttcctgagtcaagggagggagaagagaggtggaacaaaaggcagatgctggaggggaaggggagctggggagctcgccccgagggctccggcagcccgcggtcccctgcctcagtctgtcccagagggtgaggtcaaggctggtgccagggctcttcaccggccacctggagaggggagaaagagggatgcaggggtacggggttggggcagaggaggaagagcgtctgctggcacaggaccctctgcctgctctcagataggaacccagcagaagggctctgccatggacccaacacctcccacctccgcagatctgctttctcccacttgggaaaagcgaggctgacacccactgtgagcaccaggaggggcaggaagaaccgagagcctgggcagcactcctgtgcctcagtctcatccttgggcctcaccctcaacccccaacctcacccgataagacctcggggccccagctcgccaggtggaatttctgctgctgtctggccattaactgcccctgaccttcccagctccacctcaccctcgccctctcccctcagcctctccttcaccctccatgcagctgctttctgtttgccttctgctctgcacactcaggaccaggactcgagtttggtgtttgacccaggaagtgacattcctcacccaccaacccacacacacaaaaatcctgtgtgcatgtgtgttgggggggaggggcagtcattcagggctttccagggcttctcatccccacagagtctggggaactgggaaattcccaatacccgcagtgaatcccccttcctcccctcctccaggcatcccccgccccaagacagagaccttactccagaagccggggactgcagtgctgcagcagccgcggctcctggccggcatggagcctctcttcagaagggcagcagctcgcttgtcacagaccctggacggcagaaaagctgattcagggatttccgggcggctcctcctgtgggggagtgtgcatctgcatacctgggtgttgggaagggtgtgtgcgtgtgttcatgtgtgggctgggggagaggacccatgcctgagaccctctagtcaggtctgctgatccctcactgttcttcagatggaaagggggagctggggtaaagggctcaaggtcagatgctcagcaggagggcaccaggggtttccccccactctgctacactccggtaacctacccccaccacgtcgccccacactgaggaggggacctgtcacctgagatgggtgtgtgggctgaagagcagtacctgctgctcctcttcggtttctccctggggagagaagtgcttctgttttgaaatctcccccaaaccttcttttgctagaaggagggaggatgggactgaaatttcattcagcaggctggattcaggtttgactttggggtttcctgatgctaagggtctggggcagcatcctgcttgacagggaaagcttatgccttcacgattggaatgtagtgctgcttagatgaaaagggatggatgaaatgacccccatggttccttctgataaaatggaccaagagacgcctgaaccttatacaaagctgcctccagtaaaacaaaatctagttacagaaaataaagcacttctgtaaggttatgtctgctccttctgaaaataccgtgtttaatgtctgtgctgcctccaatgtgtcctttcccctcttgggtggaagtggaattctgatggcctgtggaaggattgggtgacacttgcacaggcagtggctgggccacaatggcggaggatgggaacacggtgggtccctggagaaaacacagctgtgcttcacccaaagccccttcaggccccagaggacccttcccctgatagggatgacaatgacagcctgacagtcttaatttcacttgattcttatcaactttcccaggaggcagcaaggcgaggaagggataattcttcactccactgaggcacagggagcccccaaagggtggatgactcacccaaggttctcaggtaggttcctaccttaccctggggttttatgtttctattctcaacactaacgtttctcattcctccacaagttaaattgctcactccagccaactgaagcatgcttttcttgacacagttagctcgaggcacacggttggtgttaaaaaaaaaaaaaaaaaaaaaaaaaaaaaaaaaaagagcgttatgtcaatttcattgatcaacaaaagtgatggctccactgcaaattcaagttgatagtgcctgggcctcttgagttcaagagccttctagacaaagggctctgagctgaaacatgagcatgcacacatatgcctgtcgctgggtctgatgagataatttgcatacttggttgttatccctgagcattttcctgcctcaatgcacgtgtagccaacacaataataatcatagctgataaaggctaaagctgaggactttcctgagccaggcagtggctttaaaacctttaaagtggcttttaaaactttaacagctaaagctgaggactttcctgagccaggcagtggctttaaaaactttaaagttttcacatagactctcactaaataatttctgtttttcagatcaacaaactgagactatcacatttgggattaagttaaaaaaagaaagaaagaaagaaactgaggcttaaatacttgcttaaagcaagtatttcacagccagcaagtggctaagttggaacttgagcccaggcagtctagccccgggatcctgtgcccggcagaaaggtgctgggtcaagggaggagggggcagtcgggagcgcgcgcacgctctggacttgtgcacccgcggaaaagggtgcgccgagggggtaggggcgacggggatgggggcggggtaggggcgacggggacgggggcggggtaggggcagccctttcccaggcggtagcgggggcggtggttctgttgtcctgttgcccttttaagctgcggcttgacaggggccgcgcctcctgtcggtggagtcggttacaaagggagcagccccccaggccgccacacagctcccgccaagacctggtgccccttgccattttccagccgcgctcccaggagagtggaggctgcaggaagaggcgggtctttaggctcacaagagctcggccaggcggccccgcggggtggtcgtggccatgacagcggctccagacggctccccttccacgcccttcccgccggagatgaggggaagatgtctgtgtcaagattcaaggccaaactgaagttgctggcgtctatcttccacgagaaccaggaggctcagctgcggctcacgctccactgcaacatgaggtgaggcgcccggcggcggcctcgcggggcaggaagagggcggagagggggtgcccggagtcccgggacaaaggggaacctgccccggcgaggctccccgcccctttctcccgcaactggcccggcccgccccgggactgcgcgaggcttgggtgggaggaggcggcgggcgcgtctgtctctccggctcctcgcatggggctgtcttgggggccactggcccctctcagcccccgtcgccgccccccgaggtgggagcccgcggtggcgggagccctctcgggacccatggtcgccctcagtcagccggcctgctccggggaccgcgacagggcggggaatggcggcttttgagcccaggcggggaaaggcaaaggcctttaagattttcggtgttcgaaaccagcctggctaacatggtgaaaccctatctctactaaaaaatacaaaaattagcccggcgtggtggcaggctacttaatcccagctacttgggaggcagaggcaggagaatcgtttgaacccgggaggcggaggttgcagtgagccgagatcgagccattgcactcaaacctgggggataagagcgagacttctctcaaaaaacaaaaacaaaacaaaacaaaaaaaaacaactttttttttttttttttttagacaaagcctcactctgtcgcccaggctggaatgcagtggcgcaatctcggctcactgcagcctacgtctcttgacagtccacggattaaagctattctcctgcctcagcctccggagtagctgggattacaggcgcccgccaccacgcctggctaacttctgtgtctttagtaaagacggggtttcaccatgttggccaggctggtctcaaactcctgacctcaaatgacccacctctgcctcccgaagtgctgggattccttcaatccaatcaagttgactctgagtattaaccatcacaagtgtcttcagaattgtcattcttttctgctgtggcctccctctcctggtttgcagacccatgctccgcctgtgacactaggatggggaggtgctggcaggagagctttctagctcctgagttaaaaggcagagatggagtctgttttaagattttgctgctgtgttgagttatattaaaaaacattttgtcttttccctctggttttcacactcatagtaagaggccatcaagataggcttcttatatgggagggtgattcttaccaactgtagttgggacaagaacggtaaagaatgttagattcttctggaaaaaagtggtccctccattatttggattgggtttgtggccttctcaagcccagcagtctaattccatctgctttgtgtcttccggcatgtccctgtagttttggttcactaagggtattctccttgtatctgttatttttctgctgctgtgtcagacttattctgtttagtaaaatactgtcattttggtgggattttggaaagaggaccaggccacatcttgaaattcatcttaggattttacaaccctaactcactttttgttttgattaaattaccctttttgaggggtgggggctcagctttatcatttgcaaaatgaaggatagtaactgggctgatggttacagatgtggatgcgtgtcagaatcacctcagagagctttttaaaaacacattctccccagcactttgggaggccgaggtgggcggatcatgaggtcaagagatcgagaccatcctggtcaacatggtgaaaccccgtctctactaaaactacaaaaattagctgggcatcgtggcacgcgcctgtagtcccagctacttgggaggctgaggcaggagaatcgcttgcacccaggaggcggaggtggcagtgagccgagatggtgccactgcactccagcctggcaacagagcaagactccgtctcaaaaaaaaacaaaaccaaaaacagattctctgggtatgctttgaaatgagcatttcaaaaatgctctttcaatcactgatgcaaccaaagtctttgggacttttaggctaagaatatattctttagatacccagaatagtttaatgtggagtataacaatttagggaaatgaagaagggttgaattacattttggaagctgctgcttgcttcctttttccatttagtttttagaagacaaagaatgtctaaagagatacagatttaaagcaaatataagttaattcttcatgggtatgtttatctacatggctttctccagctgactgatccagaagagttctaataccctctgtgatcatgggtttgtttttcttaagaattactccatcagagtatctaagaacagatgcttagatactgctgagacctttgttggtcttacttgatctctgaatcctagttttttgatcttctacatattctgggttttaacctgtactggccttcatggttaaagaagcatttatatactgtgcccaggccaggaagcttatcttttgaactttgcccaaactgtgtatgaaggcccttcttaaaaccccattaaattcatttctaaacttgatcattgtaaattgtgtcagttggtaaattctgtcttgtagggaggtattttgtagtaaataacatgtttttaaaactaaaatttgccttttagtaaggtggtaatcatttcataattcttagttttgtcaagtgtctataaataacacatctgatcttttaaaatgtaaggcaattgaatttatgtaatgattcaggcttttcaaagttaaaaaggtagttattttaaggaatggatagtttgtgatatttattttaaacaaaataagccattgatcttatacacatagccatgtaagtaaaatgttttcttattttaaattagattacattttaacatttttttcggttttgctttgtatttgactgattgcttttctttattcctaattcttttattctttgttccgtttttaaaagctgataactgttgtttgtcaaatcaaagttggatttaaaaataaacatttaattttaataagctctctgctagtggcactgcagtgacagatggttgagagtttgtccctaaagctatggcaccggtcttctaattgactcaccctgtattcagcctgtgtagccctggcagattctttctctgtttcagaatgggacaacagaagaagtgacttcagaggaagaggaagaagaggagatggctgaagtaggtattttatataagaatgacatttcataaatgtcgtcatttttgatttgaggaattctctaaatctcctttgtaaactactattaatgtggaataattgaaagcacattgtatttggaatggaatataatttctcacctctggctttacctctaactgatgatacatctttgagaaaattgctttatctgaattctttggatttgattttctggaaaacaaaagctcttaacttttagcaccaaagttgtacttatatttaatactaatcagtccttaacctgtatttggttatttttaggaaaaggaactactaagtttaaaaaatgttatgtttgcataaaaggagaatttgagaacatgttagggactactcaccagaagtagtgacactgtctcttgttgaaaaatcatcaaggaattttctcttagtctgttttatgctgctataacagaataccagagactgggtaatttataaagaacagacatttattttctgacagttctggagactgggaagtccaagatgaaaataccaacatttggtgtctgagggccttcttgttgccacctcacatggtagaaggcagaaggcagaagggcaggagagcaagctagtccaatgtgtgaagcctcattcatcagggccttaatcccattaaggaggaaggagccctcttggcctaatcacctcctaaaggtcctacctcttaatatcatcacattggcaacacctgaattttggagggaacacattcaaatggtagcaaatttagtagagcacattccaaagacattgagcctaggccagttgtcagtcatgggtctaattttagacattttcaggctctgaagctttgcatttaaattcaaactccggaacaaagatctgtgtctctgcattgaccaaatagaaggtatgtgaattttatggtcttgatcgttttacaagattttttctgtttggggtcttataattaatataggctttcattttcttggtttggaaattattaatctaaaatatactttacagtgcttcagaactaaagaagtagtgttgtgggcttgtttttgtttgttttttttaagatagggtctcctgtcacccaggctggagtggagtagcatggtcacggctcactgcaaccttgaactcccaggttcaagcaatcctcctgagtagctggaactacaggcgggtgccccacgtccagctaattttttaaattttctgtagagtttgagtctcgctctgttgcccaggctggtcttgaactcctggcctcaagtgatccaccacctcggcctcccaaagtgctgggattacatgcgtgcaccactgtgcctggctgtaggcttgttttataagtctgggagtaaaatacttcttaaaattgtccaattagaatgagagtttaggctgggcatggtggctcatgcctgtaatcccagcactttgggaggccgaggcaggtggatcatgaggtcaggagatcgagaccatcctggctaacaaggtgaaaccctgtctctactgaaaatacaaaaaattagtcaggtgtggtggtgggcgcctgtagtcccagctacttgggaggctgaggcaggagaatggcctgaacccaggaggcagagcttgcagtgagctgagatcacgccactgcactacagcctggatgacagagcaagactctgtctcaaaaaaaaaaaaaaaaaaaaaaaaaaaagaatgagagtttaatgtttttatgcagtttagctcaggtagaataaagtgcaagaaaacattgaaccttttctgtgggtcaggaagccattgtagtaaagatcatgaaccctttcatcttcccctcacaaaataataaacaagggactgcaactttgagggaaatctagaaaggtaggagactggactttggagatgtcagattaggactggtgaaaagcagatattctaggctcctaaaataacgtgggaacaagcccagaacaaccttggacatggtgtgtttgtgcatgggatgcttttcttttgagacggaaggttgatgtgttgaagtcatggaaagtgttcaaaatattgtgagaattaccgaaatgtgacacagaaacatgaagtgagcacatgctgttggaaaaaaatggtgctgatctacttgcttaatgcagaggtgccaaaaaccttcagttgtaaaacaaaaaacaaaacaaaaaaaacaaaaaacaataataaaaaaaaggaaaactgcaatatctacagagtacaataaagtgaagcagaataaaatgcagtatgcccgtatgaaagattatgatgtcggtgaacaaacagttgtatgccttcctttccaatgtgtatgccttttattgatccttgttgcttaatcactttggctaggacttctagtactatgtgggaaaaaagggacgagtatgagcatccttgccttgttcttcatatgagggggaaagctttttaccattaaatatgttggtgtcgggttgtcataaatggccattgttaagttgaaatatgttcttatttgtttgtttattttaactagagatagggtttcactatgttgcccaggctggtcttgaactcctgggctcaagcgatcttcctgcttcagcctctcaaagtgctgggattacaggcgtgagcctttctgagcgttttttcatcatggaaaggatgtcaaattttgtcaaatgctttttgtgcatttattgagatgatgatatgttgtttatcttttatgctgttaatgtgacatatcacaattactgatttttgtatgttgaatcattcttgcatcccagggataaatctccttaatcatggtggtatgatatggatttggtttatttggccccactaaattttatgttgaaatttgattcccaatttggtagtattgggaagtagggcctcatggcaggtgtttggggtctcatgaatggcttggtgccatcttgcaatagtgagttctcatcttgcaagactggattggtttttggggtaataaattagttccccttggagtaggttgttacaaatccaggataccccttgggtttgttctcatttcacatatgcccgcctcaccttttaccttcttcaccatgttttgacacagcacaaaagccctcaggagaagcagatgctggcatcatgcttcttgtacagcctgtagaactgtggccattttaatgcggtattgaatttggttttctagtcttttatggaagatatttggatctgttttcatcagggttactggtctgtgattttctcttttttgtagtgttctggtttggctttgatatcagggtaatgctggcatagtaaaatgagtttggaagtggtccatcatcttcagtttttttgaagcaattgggatatactgacattaattcttctttaaatgcttgatagaattcagtagtgaagccatatgattcttgtgcctcagcctcctgagtagctgggattacaggtgtgcaccaccgcacctggctaatttttgtatttttagtagagtcggggtttcaccatgttggccaggctggtcttgaactcctgacctcaagtgatccactctcttcggcctcccaaagtgctgggattacaggcatgaaccactgttcctggcccatagacttctttttgatggagattttaaacaaccaaattgatatccttaatcattactggtatgtttagtttctccatttcttcatgctttggacttggtaagatatggtttctaggaatttacctacttttttaggttatcttttttatggcatataattgttcatcatagacccttatggtccttcttatttctgtggtattagttttcaagtctccactttgatttatgattttgtttatttgagtcctgtcacattttatcttagtccagcaaaaggtgaattttgtatgtcttttaagaaacaactcagtttacttttctgttgtttttctagtccctacttcatgtttttcagctctgatctttaagatttccttcttctttctaacattggagtttgttcttctttttctagtgtttgaggtataaggttatcttacttatttaatatctttcttttttcttcacgtaagattttatcactaaaagtttctctcttagaattgcttttgctgtagcccataatttattatttatttatttatttatttatttatttttgggatggtgtctcactctgttgctcaggctggagtgcagtggcatgatctctgctcactgcaaccttcgcctcctgggttcaagtgattctcctgtctcagcctcccaagtaaatgggattacaggcacatgccaccatgcccagctaatttttgtatttttagtagagacaagatttcaccatgttggccaggctggtctcgaactcttgacctcaggtgatttgcccaccttggcctcccacagtactgggattaaaggcatgagtcactacacccggcctagcccataagtttttgtatgctgtgtttccattttgatttgtatcaagatctttttaaatttccctcttggaaaatttaccacttaccctttggttgctcagaagaatgttgtttaatttgcatatatttgtgagttttccagtttttctttttattgatttctagtttcataccattgtaatcagaagatattcttcatgcagtttcaatcgtcttaaatttgttaaaacgtgttttgtggcctaatacttaaagtaatttggaaataattttatatgtacaagaaaaaaagtcttctgttgccttttgacagaatgcattgtatatgtctgttaggccctctttttgtctaaaatgcagttcaattacaatattttctcattgactttctatctgaacaatttgtccattgttgaaagtgaggtattaaagttttctactattattgtatccagtctgtctcttccttcagatttattaatatttgctttatataatttaagtgctgtaatgttaggtgcatatatatttgaaattgttatatcccctgatgaattgacctgtttatcattatatgatgatcttctttgtatcttacgagagtttttgacttaaagtttattttgtataaatttagctattcctactctcttttggtttccatttgcatagaatataaccttccttatttacattgactctaagtgtgttcttaaagcttaagtgaatccgttgtaggtaccatattgtgtgtgtgtgtgtgtgtgtgtgtgtgtgttcaatccattgagcagtctatctttagagtatttaagcaatttatatttaaagtaattattgataggtaagcaattactattgccattttgttaattggtttctagttgccttgtagattctttgtttgtttcatcctctcttgctatcttcctttgtgaactgatgatttttttgtaatgagtggtatgctttgattcctttctctttttcttctatatatcaactagaggtttttggtttatggttaccgtgaggcttacaggaaataccttttagttataaaagtctattttaagcttataacaaattttctttgatcacatacaaaatctctatacttttacaccccttattttttgtttatgatgtcaaaatttatatctttttaatattatgtatccacagactattgtatttacagttttgttaatacttttgtttttaaactttaagtgatttacacaccattacagtattagaatattctgaatttattagagtattagaatattattagagtattctgataaacttccatttgtcagttttatactttcatatgttttcatgtcattaattagccttgtttcattttatcttgaagaactctctagcatttcttataaagcaggtctaaagtggtgaactcctcagcttttgtttgtttagaaggctttagatctccatttttgaagaacaacttttttaggtaaaatattcttggttagcagtatctttctttcttttaccagtttgaatatatctatataattctactatcttctggctgtaaggcttctgctgagaaatctgctaatagtcttatcagagtttgcttgtatgtgccaagcctcttttcttgttgctttcaaatttctgtgtcttcaatttttgacaattcgttatgcaggtgaaggatcccttatctgtagtgcatagaatcgaagtgtttcagatttcagattgttttagattttgaaatatttgcattatacttaccagttgagcatccctaatttgaaaatctgaaatctgaaatgttccaatgagcatttcctttaagcgtcattttagttctcaaaaagtttcagattttgaagcatttcagatttcaggtttttagattagcgatgctcaacctgtaatgtgacttgtgaggccttctttggattgaaccttattacagattgcaagctttgtatacctgaatgtccaggtttctccccagactttggaagttttcagccataatttttttaaataagctttctccgctttctgtctttgttcttcttctagaacatccataatgcaaatgttagctgtcttgatggtgttccactaatctcatcggttttcttcattccttttcattctttttaaaaaaaattttccttttctaactggatattttcaaatgacttttcttcaagttcacagattcttttttctgcttgatcaagtctgttggtgtttttattgcattttttgaattccattcactgtgttcttcagctctaggatttctgttcagtttccttttcatgatttctatctattcattggaattcttttgttgattcctattttctgttttatttagttgtctacctatgttttcttgtagctcactgagcttcattaaaatagttattttgaattctttgtcaggcaatttgtagatctcaatttctttgggaaaaatcaagttttcttgatttttcatgtttcttgaagtcttctgctgctgtctttccatttgaagaaggagtaacttccttcagtttttacttactataaataccttcaccaaccagattggttagtgattatgaggctctctcagactttttctgtggattcacccactccacacttcttatccattttgggggagggaaatgcttaagattatacactttctttcaatcttgcaaagctaggccagggctgagagcttcctgttttgattttctagagtggtgcactgaaatgctcaagtttgtgtgtcttcctccaaccctgcatagttgatacagatacctgcatgaagtgcttgcatttgctgttcacgcaggtgcatttagggaaccaatcttgggagcgagttgtgccaaacattttgagtgcccatgcaccagttcagggggtccaaacacaatgtgttccaagtgccttatagatgcacttcctgatggaatcacagagcagtaaattagatccccacctctcttccctgtcactgttctcttccaaccactaaaccataccaatcaccattgtagtttggataagatgagaaagtgggtgtcttgttcagtatcctacaaagctgggggagctgggcactcatgaaccatgcttgcactctccccacccaccaggagaaatcatggactgcaatgatctctcttggcattgagctatgatgccttggaggaaaggtaatgcaggtaaagtgaaactgtttttcttatctttttcagtgcatctattctcagatttttgttctgatggcgtgctaaaactttatctgctggattcttggaccccacaaaagtgctcttatagataattgtcaagtttgatgcttctgctaggcgataatggtagaacgctcttattccaccaccgcgtgaacatcactctgctttctctcttaattctgccttattctgcacattagcctcattttcctccttggagcttgtgaaggaattgaagatgccagaggcatcagtcttattttatgtaaggatgctcctaaaccactaatgataggacctaaaatctattgttgaagattctgagatatactctccgtcttttagctgatgacctcattcagggccatcacagcttacaggccaaactgtctactaaaaacattaggaagtgttaatcacatagacctcttctagagctgtgcagtgtgtgaccggcacagccatatgcattagccatgataccccctacttcatcaagatacagcagtaatgatatttagtgtctcttatcttttctacaatacccttgaatacctgccatcctacatatattttatgaaatgggagactgaaagaatgtattttcaaagtaatacactttatgtaatatgtggtttttacataaacttatttatggaaaattaatgaattcagtagtaggttttgacattttattattttatctggtaggaaaaagtccttctttcttaaataaggacttaattagtccttatttcttaaggcctggatttgcaagattgctttcaaaattgcttcatgcatatttttatattttcaattccatatgaattttaaaatcacctttcaattttattgtgcttgtatgaaagttttgggttaacttcaagacagctgacttttaacagttaaaactttccaactaaaaatgtggcttttctctcaaatgacaagctttgtataatttcttatagcttcccttcttgttttctcttcaaaagatttttagaatatttttgttatgatattatctttagatgaaggtcaatttgtatcttcttcttttatatttttagcttggtgggccttttcttgaagacacttgtctttctttaacattgaaatacatttatccattgttttaggcaatttgtacctctccattttctttgttctctcttttgggaactcgttttagtcaaactttgggcttcctgctttgatcttcattaatcctttagtctttgttctagtgtttttagtgtctgaagtactttttaaggttatccatctgggtatgctagagaatgctggtctgggtatatgttttacatgggcatatgacagaatcagcattacctcaaatggtcaagctgcctttcctgtgttgaggacacagagtttttacctggaaaaagtatggagacagaggagcaagaggagcctgtgctgagcactttctgtttgcccctccagacttacagttgacctttctcaattcacatctgccctttgggaggctgaccatatctgtgggctacttcatctttgggctttctgtggtgccctggaagaaggtaagagtgtggggccgtaacattggttcctcccactctctctccacgtggacagcccaactgcctcctctcaggcctccctctctgccagacctctggcgctggctttctgcagttgctccttcccttgcccttttggacccagaggttgtaattataaccccagcgtcacctctcaggatactgtattatccatccctgtgattttcccaccctggcccatacttgcgtaaaagtccttttattattctcaaataatttaaattgcatgttccatgtatttcctacaggtactctgaaaaatataaatgcccgtaatcccagcactttgggaggccaaggcgggcggatcacaaggtcaagagattgagaccatcctggcctacatggtgaaaccctgtctctactaaaaatacaaaaattagctgggcactgggctggatgtggtggctcgcgcctgtagtcccagcactttgggaagccgaggcgggtggatcatgaggtcaggagttccaagaccagcctggccaagatggtgaaaccccatttctactaaaaatacaaaaaattagctgggtgtggtggtaggcacctgtaatcccagcaactcaggaggctgaggcagagaattgcttgaacctgggaggcagaggttgcagtgagctgagatggcgccactacactccagcctgggtgacagagtgagactccatctcagaaaaaaaaaaaaaaaaaaaaagggtggcatctgcttgtagtcccaactactcaggaggctgaggcaggagaatcacttgaacccaggaggcagaggttgcattgagctgagattgcccaccacactccagcctggcaacagagcgagactgtgtctcaaaaattaattaattaattaattaattaattaacataaacaacatgtaatagagaggttcaataaggccaaaagtggttcctttcaaaatttgaatgtaacataccaacactgacctaagacatattagacattaataatccaatggctaataagaaaatacattttttttttttagatggagtctcgctttgtggcccaggctggagtgtgcagtggcgcgatctcggctcactgcaacctccaccttccaggttcagccagtcctcccctctcagcctcccaagtagctaggattacaggcatgcaccaccatccctgacaaatttgtttttgtatttttagtagagacggggtttcatcatgttggccaggctggtcttgaacccctgacctcaggtgatccaccctccttggcctccgaaagtgctcggattacaggtgtgagccaccatgccaggcctagaaaatacatttttaaattaaaaatattacttctgcaatatctccagacctagaggcttcaccagtaaattttgctaaatatataagaaagaataataccaatcttattactcatgaaattgataaataccagtgagcttgactgaggaaaaaggggcaaggacacaaccaatgacagaaataatacatggaattcagtatagtcttctaaaacattacataatggtaagacgatgttatatacaattttgtatcttgcatttgaaaatgtatatgaaaaagacatgttcctagaaaaataaagctcattagaactcacactttatcttcctcttctctctctgtttctttgttttgttttcttttgttttgtcttctttcactcagacatataggaggtccaggcagcatgaacagctccctggtcagagacacatggatttgctcactggttactcaaagctgattcaaagccgattaaagctgctgcttcatctggggtcccaacctccagtgggaaaaacattcttcttttcctgctggtgtcacccactgttccacggatccaaaacaacacccaatgtttggtacaaatttagtgaaacagctctttccattcttaactcatgccaagcatctcagcttggggtcaggaaaatgccaggggacatgagctcttctcctagagttagagaattctctgccttagttgcaataaaggaaaagatacacattcttcctacaaatgccaaagtaggctcaaaatttggttcctagagtagagtattgaagtcgtggcaaagatctttccagtgatcaaagcagtggctcgttatgttccctcagactgaagctacagtctcatcttcactttctgttagctccctccatcctctgcgtaggcccacacctgcttcttacagttgtgtggattatagcacctcctctccagcctcaggacctttgtgagtgctgctccttcttccttgactgctcttcaccagggatcctcagggcacagcccttacctcctgcaagtcttgacttaaatgtcactttctcagggaggcccacactcatcaccatttcacacccacctcccacatgaccttattttacctgttctctcttctcctcttttttttagagtacttatgatctcatgtggtacattttggggtttttggttcttctgtatccgccactgccatgatcagttagaatgttggaaaccaaggaaacttggttttttggcctgtgatgaaaactatggggtctaatagtatctgataaagtggcagaccctcaattattatttgctgagtaaatgaatgaaggtgtgtagacaactagctctagaagcttaaatgagtgataccatgttttataacattggaagaggccgggaatggtggctcacgcctgtaatctcagcattttgggaggccaaggtggatggatctcttgaggtcaggagtttgagaccagcctggccaacatggtgaaaccttgtctctactaaaaatgcaaaaattagctggacgtggtggcacacgcctgtaatcccagctactctggaggctgaggcacagcatcacttgaacccaggaggcagaggttgcagtgagctgagatggtgccactgcactccagcctgggcaacagagtgagactctgtctccaaaaacagaaaaaagaaagggggggaagaaaagaagaaggaagaggaaagggaggaggaggatttatcattcacttacactagaaacagtgaaaatagataatagctataatttactcacatcttatctaaaacacaaattcagggtaatttatgagcaagtcattttccggtgggctttcgatagtgtgtgaatttggaatgaatgctggtacttccagctcccttccacctgcagcaccaggaagccattgttgtggggaggccaccaacttggctggcatgttgcttctgcctcagttagtgatgatggtgatttggagagaaaggacactctgctaggctccaaatccaaaggatcaagtggataaatgaaatgaatatctaaataaatatcaattaggtcaaaagtttgttttcatctaaatgaaatctgaacactacttagggctatgaaacatagccagaggacatggccagctctggagtggggcctggacttgctctcccctgctggaagtgcttttcctcccagagctcagagcaccatgtgcgtgtgacccctgccttttcacaggccattgccacagggcatctccctggtccacccgccccaagatgagccagcctcccactcaggaagtgggtggggaagggaaagaaagacagaggagagagagacagtcacacacaggcagtggagctcccctgcacccaccagggagcttgagcagctcatctgcagagcagggaaacatttttactaccattgggaagacgctgagcagagaggtgaggggacagcatttcttgtctccctgtggcttgttccactcacagttcagtttctcctgttcttggggaaaaggagggaaactgtattagtcagggttctacagagaaacagacccaataagatgtgtgcatgtgtgtgtgtgtttatatatgttcacagaatgtatatatgtgtatatatatgtatatggataactgcatatatatattatttatagagagagagaagagcaggagacagagataaagagagattcatataaagaattatattcataatttatataataatttgttcctttaatcataaagtctggcaagtccaaaatctgcagggcaggccagaagcctgggcaccccggaaagagttgcatctagactctgaagacggtctggaggcagaattccctctttcccagggaattccagtctgttttctctgaaggcctttactgactagatgaggcccccacacacatggaaagcaatctgccctactgaaagtctactgacttagaggtttagctcatctaaaaaataccttcgtagcaatttcgagactggtatttgaccaaatagctgagtaggttggcctagccaatctgacacataaaattaactatcacagaaacaaaataatcaatataggtaataactgtgccagaatgctgtgatgtttcaggatgaccttgtttacatttacatttattgtcaaaacttaccttctctttttatatgggcaattaaatctgctactgagggtatcaagtactgatttaatttacaatcttaatagataagataggttcctattttctcctctccataaaagtaataagtttggagaaaccaggtcggaaatacctctccagattttaaagcataacctcttgtttggaataataagtatgtaaataagcaccataaaatatgaaaccaaacatttcatcattcttttatatacattatcccttgcatttttaaaaaataaggaacaccttattagccatattttcaaatggtgaaaccaacacccccagctcagactctgccgtggtaggctccagggtcactgataccagatcccatggtattttcactatatcccactctttctttgcatgtggctcttttttagctgcattgcgggtaaacaggtgtggctcttttcaaaccaattccatgcatatgtgaagaaaattgatcctgaagttccttttgccaaagatgcttatggagaagtgtctgtgtctggacagacaaaagtgtccatttttgcctcgaagcttggcaaaattgaaattgatgatggggaagctagaaatacttcagtctacatttcgaatcccagctgcggggaggctggttgaggattgcccatccctcagtctgggctggattctccctccagtctctggggttctcttttctattcacaagagggtgctaatgagatggtttaatctctataccctgtggtccacaaatacaagatgccagcgtggccaatggggcttccataagagtggcaatcaggggtctcaagcttaccatgacgttttgggccctggaatcagatcatagttctacagttgtcctggcactagaactcatgacaaggttgtgactagacagaaggagagaaggctggaggctgacaggaagcaatgtgaacaaatgccttcgcaggatgcatgggtttgggcaacagatggtcaggggaggtgctggtgcagacgggctcagtagcaaagcaataactgtggatggccattttatggctgcagatcacagcacatttataaaagatgtgtgtttcatgaaaatgtgcatttcatcgtggaaatactgtggttggaggagatttctcaaagctgataaataagtgtaggtgacttaacttgcaaaagatgatcatatgtgagaacggatgtctcaaattaggaaataacttgttaagtaaaaaagcctcatgtattgatttgaagaaaaagatattttggtgctcatcaaaataaaagtataataagctgaagggctgcttttttctgtaaacataattttgtatcaccagttttattttcaacgaggacttgaaattcagaaaaaaaattaaagcagagaaatgggaaaagggcaaaaaaaaaggacaggaaaataaagccagaaaaaggcaaatgagtacagaaaaaaataaagtatccactcaggttctggacactttgttagaactgagaacacacagatccagaacttcctagcagttagtgtaagtaggaaatatcactgttcatataattcaaagggtttttaagacccaaagaagcatagatatctaactctgagatctcacagttctctgatggttctaataaggaggacatggtatgaacaaattatgccttactgttcgctgaggttatatcaatgcccgaacatttcatccagcaaagcagtcacaactaaaaacaggtacatgatggttgcagacagcttctcagtagcccagagagtgagagctcaccagggcagaaggtccctgaaccagaggctggcagtgcacatgtgctttggtcagaggagaaggacaaccgtgccccacggggctgaggacccagtggctggaacaaagacatgatcccaatttttttgatacctactttctcactttgcctttgggcctccacggagctcctgtgcagctggctggaccatggcctatgtacaatggctgagtctacacacaatcagaaaagcagcctgaaactctgtggactgtgtctgctttattctcagcaggattaatgaccctcattgaattcccatcgcctcaaagcttggcaaaattgaaattgattatggggaagctagaaatacttcagtctacatttcaaatcccaacataacctgagtaagggaattgcatgcttttctcatcgaaagctcaaataacttagtaatggttcaaaattgtctcctactggcttctcaatttagcacactaaatggtcttagagatcattgctcatctttggactaaggcaggcacagtaatacatgttcattcttttggcctgagctattacagtagcctcctaataacttatcttcatcatcctcttttcactcattctatactgggcaccatgtctgatcatttttttttctgatatttggatcagttctattaaactgataaccctgtgatgtctttttttcccttcaatagatctttaaattccaatcctcaccctaatctactctttcccaatatagcaccgttattcacactgctcccaaaatctattccatcctctgacttctcacaatttttttttgtcctaagactccatgataatagagaaaagaattttggtcttcacagaatgtattgacttaatgatattccaaatttctcttgggtgtcaaatatattcctcaccaaatatgactgaaagaaaactctattcaccatgaatttaaggatctcaaaattataatatcttctccactctcataattccacagcccctgctgttactataatgacctatattgcaaaagagtgaattcaattagagtccaagaggaaaactgctggtatttttttcatcttttgccatcccatactttataaagtgcagttagaccccctgtttgcctcccagcataccaaagttatgtagattattttaaataaaatctactgaaagcatgcatttttaagtaccccttttgtgtcccctaaattacagaggataaaaccagccatagaggcaaattcctttagaccttctcctagaaacaaacactatccattacataaaaccttcaattgcaaggacagttctgtaaaccatgatatttgatcctggaagcttcctagattgaacacaaagaagagggtacagtatttacatacctccagctttaagctgtgtgcctggtgtttttcactccaaggtggttgagcatctccctctacactgccatctaccccattcctcatcacaaatgtcaactctgtctgagctgccttccaaagtaagcagagaactcaggactgggaaaccagatggggctggcttgggaagtgtggcctacctgttccctccatgaccaagcacaacactgtatgtggggaatgaaatgggaccaggtcccagagtactggggaaacagaacctcatatccaatgaggagttcgggcaggcaggtcaaagatggacctgagaccaactcactgtgatgggtgtcaacagaaaagaagacatggcctcagaagagatgctccctgagaagctgggccactttctcatgtgactgcagagtaatccatccctgcgtggagctgacaaggcaccaagctgctgggcatgagacccttcacatatcctctctgatcttctcgattagctctgaagtctctctggtttgaaacctcatgtcacttttttggtatgtctctgtggcattggacatcttctgcctcatattagatgcattgtgtagtgtttacttatccctaatttgcagccgcttatctgagcatagacactagaccactccatctttgcctctataaatatcaggtgtaggacctcgtacttgacaggtgctcataagatatctttctctccctttttttttttttacttgagttcaagtgatgagggtctagtaataggtattgctaagcagagcaaattcaaataattgtttagaaaagtattgatgactgtatctgattaagagtataaaaaatgggggaggagctatgctgagcccccaattttaagttagagacaggagaattctgatgcctgccacaattgatatcttataatgctgcatttgcaagcttaacattcaatcgtttttcatttagagtccaaagcaatcattgaccatggtgcctgggtgttggctgtgaagcctgaattctaaaacacaattgtaaacgtattttgccttatattgagataagcacatacaatacttaagacatgcaatattttaaagaaatacaaaaaaattgctaactggccacatcagttcttaacttttttattaaccagaactggtttcctcttgctgttagttccagaagaaaagattaaatcagaatagttctatatgttttaccttgtgtattaggtatcaattgttgcacaacaaatcatccccaaacatacaggcttaaaaccaccattagttcacagtttctgtgtgccaggaaactggatatggcttggatgcatcttcagctctgaatctctcacaaggtcaccatccagctgtcagctcagactgtaatcttgtctaaaggtttaattgagcaaggagccactcaaacttaactcttgtagagttggcaggattcagcccctttcaggttattggacagagggctcagctccttgctggttattagctgaggccacctcagttcttgactctgtgggtctctccattaggaagctcacagcatagcagctggtttccctcagactgagcagagagcaagagagagtgctcaaggcaaaagacactgcctttttgtaacttaatctcagaagtgacatctgctgtgttctgtatgttagaagtgagtcactaagtccagctgaaactcaggggagggcttgcctaccaggaggcaggaatcaccaggacccatcagagacaccgtctaccccagtctgtgctcgggtccttcatgtctctccctcctgaaatttgatagattctgcaaaagaaaaagccttgatccacgctgctttctagaatgttgtagtgaaaagcaagtcagtgtggtacattcagagtaattttataattttataatttaaaaataattgacattactcccagcattaccaaagttgccaagatcagcttttaaatgctcacttaggtcatttgtgtttaatgcattgagtgtgtgctcaatcttcatcccaagacagagggattcagataactggcaaatgatatgaaggaaaacctttctggagtagtccatctggaggccacgtcaggactagcctcacaggtagagtacaggcattctgactttgggagcattaaaaagagcatcaaaccaaattatctgattcagccctatataatagcctacataagccccaaagatctctattttaaattagaaataaagttaatgtttcacttgaacattctgcaggaaagtggtatgagatcaaggtattattaactattaacaactggctgggcacagtggctcacgcctgtaatcccagcactctgggaggctgaagcaggtgaatcacctgaggtcaggagttcaaaaccagcctggccaacatggcgaaaccctggctgtactaaaaaatataaaaattagctggtcatggtagtgtgcacctgtaatcccagctactcgggaggctgaggcaggataatcatttgaacccaggaggtggaggttgcggtgaatcaaggttgtgctgttgcactccagcctgggagatgagtgaaactccatctaaaaaaaaaaaaaaaaccgaaaaactattagcaacttagcatgaagcactctgtcacctgataagaactgagaaagtgtagcacaggacagatcaggtttgtcttgatggaagaaaggaaagaggaaattactgatggtaatcttgagccgagcacagagaaaggcaagaagggatggctctggtttcaaacaatccatgtctgattcctcccaagcccattctttgttatctattgtaatgtcaatactcatattaggtagggagttccctttaatgacctctaaggattctttcagctggaagagttgtatccattcatctgctaatcttcttcatcaaaggacagttggaaaggatgcggcattactccttacaagaaggtggaagtctaatttttaaactatgagcttttaccttaatgtgagccatttctttttaagctaggcatttacatgtactccaatataattccttagtagaatacatttatttttggtgcaaaacaaaattatttagtccagagacacccttcactggcaaagaaagacattcattgtgcagtgcagtaattcagagaaatattacttccaagtctttttaaagttaaagaagaatgttttagggcccatttgaaaagtgctattcatatgaacttgaaggtcattactcacagataatattcaggagaactcctgtctaggctgagagcagccacttctgtgctgtttcaagttttcagaaaccatggtactgttactcctctataaggtagaaaaaccatatctaacatatttgatttattccaaaaactcagcaaaatcgatttctttttcactctttggaagaaagtacagaatgaggaaaatcacttcttaaaaaattcatcaaaataactatgttaagcccttatgatttccaggccctgagcccggttctggagtcatagagtttagaagaaaaagatggaaatatgcaatccagtgggacttcctttatcaaatgaacgcaagggcctgatttctttggtagataatgcgttcaactaaacggatctctttgagatgaggatattagctgcgctgcactgtctgtacaattgtgtctgtacctggaggagtttccacagcagcagagcctgagattctatgcattttagatttagaaacctcattataccagttcctacaagaataggtctctgaaaggacgaatctcacaaatcaagctcataaaaaatgcataaacaatgcttacatcatttataatgagaagatgttcattcccagcaatagggcagagcagataattgagtatctccctagtgcagaacattcagaagtactggatactgtagcaaacagtttcaaatggagagctgaaattccaacaaagtcccaagaccacattttaagacgaatctgcaaaccagaactgtaaagcacatgagtggacctcactgacatctttgttttatagtaggaggtggtgctctgggctgcatcaggtagaaattagacctagatccacagtaagcctgtcctatatgctgacactgcccctccctcccagtaagccagagactagaaaaacattcaacctcctgtgggttcagagaaacaacagagagcctgtttgactgatcgcaggttctaggtggtaaagtctcccctaagaatttataggcaaaggctgatgcctccagtgtattcacgtgtgaattcatgctctccttgtggcttgggagtggacaaagtaagacactgataggaattgtttcctggatggtaataccactgtgacattgttgtgggaagcaagctctgagacagagactgacatgcaggagagggatgagggaatgctcttggaatctccacctggaagtgaggagtagaaagcaggactgggactgggccgaggaagagggcaagactcagccagccttgcagggagttctaaagattacgtggctcttaagaattatctggagtagggcgagaggcgaggcccttagtgctccaagtgaatcagtctcgggatgctctgggagggggccatgaccttgggtggtggggccatgtcggaagggctggcacctgactgcactgtcagatggggcaggcagtaagtccttactcctgaaaggactgtctgtccagggcttctgctggcagcactgtcagtctcggggcaataagccctttactcctgaagggatatcagggtggccatcactgtgtcaccacagggttctagcagaagcaaacacaaggcagctgtgaagggcaggccctccacctaggattccagttgacccatctagcaggataaagatagaaaatgatggcagttctcgtaactacagcataattaatttcagatttaaaaaaccaggtgaagctaaaataccagattttaaataatggaacttgaaagggagctgattagaattcatgaatcctaaggtctttgaattatcctggttaactggtggaattaaaactgtatagttaactatatgtattaaaatatgaaagggaatcttcaaaaatagggaaataaaatgtatagctctccagcaagatactaaaaagcaaaaacagaaaaatgaacataatacatagcatataataaaaagaatggaatacatctaaatgtattggtaaaataataaatataaacgatcaaaagatgtttcttctaaggcacaaaattaacattatctgccactttatacgtagaatctggaggaccttgaatagcctaactataatacccctacccaccctgctccagtggcaggtccactagacaaccttccttatcatgggtggcagagcccggaagcaagtgtcactccaccctcttgttactacaaagcctgactccctcagctcctgcttgttcactctgtttccaagcgcagccctcatgtggccccacatcatgtggttccatcctcccctgggctgtgtgtgcctgtgactaataagctggtgtgaactcaactgtctagtgttgggtgtcatgtgtccagtcatttccataaccccagtgtgggaatctctcctccacaaatgggatggagacgagatgaatacatgccaataaaaagacatagatattcgtattgaaatattttataacagaaaaatgttgagagtaaacatgtgtatagtatagggaaatagacatattaatataaaaggaaggaaaatatatagcagacattttctaatcagaagaaagccaccatggtattattaccatccagaaaaataaaccatacagtaaaatgtatcattaggaataaatacattcagtacatgagggtcaagtattcaactcctcagaaatagacaacagtttttgtctaaacctaagaacataatatcaactatgcacagtcagaacttcatgaagaaattggtaagtaaagtgatcacatatttgtcaagtgtgtcaatatttaactgcaacaaataattagaaagtacatattctcattcactcatggaacatttataaaaatgggctatgtgccataaatacaagaaaattttcaataaagatatgcagacgttatccaattgttcttcagtcgtaaggcaatgcaattagaaatcaaaataaaaaataacaaaaaagattgtatgttaatattttaaaatcctcataagtcagtcaaataacaatttttatttgtaatcataagaaaacatttgtattagtaatatattgttgcataacaggtcgcccccctacttagtgatttcaaaaacaataatctttgatgatctctcatttgtgggtgggtcatgtacttaggagcagctcaaatatatatttctggtttgggagctctcaggaggcttcaggcagatgtctggggtaacggccatgtaaagacttgaactggtcggcggctccgctccgcactgccgggcgccgcctcgccatggacgcgcgcgggggcggcgggcggcccggggagagccccgccgccgccgcgcccccccaacagcagccgccccgggccgaggcgttgcccccggaggcggcggaggagggcggcccgcggggccagcgccgcagccgcgacagctagtgcggcagccccggcatcccgggcacggcgagcacggccaagggcagccggaacggccgagtgcgggcgcggctagccgcagtgcagccccgcggggcccgagggcccggcgcgggggcccaaggtgtagttcttgtgccccggggcggcctcggggcccgcgccggggccggggccggggccggcggaggaggccggcagcgaggtggcggcccggcggcggagccgcgccgcagccgggccagcttcatgcagcgccacttcggcgcgctcctgcagctgggcgtcaacaagttctcgctgcggatgttcggcagccagaaggccgtggagcgcgagcaggagcgcgtccagtcagcggggtcctggatcatccacccgtacagcgacttcaggttctactgggacttcaccatgctgctgttcatggtgggaaacctcatcatcatcccagtgggcatcaccttcttcaaggacgagaccactgccctgtggatcgtgttcaacgtggtctcggacaccttctgcctcatggacctggtgttgaacttccgcaccggcattgtgatcgaggacaacacggagatcatcctggaccaagagaagatcaagaagtacgtgcgcacgtggttcatggtggacttcgtgtcctccatccccgtggactacatcttcctcatcgtggagaagggcatcgactccgaggtctacaagacggcgtgcgccctgcggatcgtgcgcttcaccaagatcctcagcctcctgcggctgctgcgcctctcgcgcctgatccgctacatccaccagtgggaggagatcttccacatgacctatgacctggccagcgcggtgatgcggttctgcaacctcatcagtatgatgctgctgctctgccactgggatggctgcctgcagttcctggtggccatgctgcaggacttcccgtgcaactgctgggtgtccatcaatggcatggtgaaccactggtggagcgaactgtattccttcgcactcttcaaggccatgagccacatgctgtgcattgggtatggccggcaggcgcccgagagcatgacggacatctggctgaccatgctcagcatgattgtgagtgacacctgctacgccatgttcatcggccacgccactgccctcatccagtcgctggactcctcgcggcgccaataccagaagtacaagcaggtggagcagtacatgtccttccacaagctgccggccgacttccgccagaagatccacgactactacgagcaccgttaccagggcaagatgttcgacgaggacagcatcctgggcgagctcaacgggcccctgcgggaggagattgtcaacttcaactgccggaagctggtgacctccatgccgctgttcgccaatgctgaccccaacttcgtcacggccatgctgaccaagctcaagttcgaggtcttccagccgggtgactacctcatccgcgaaggcaccatcgggaagatgtacttcattcagcacggcgtggtcagcgtgctcgctaagggcaacaaggagatgaagctgttcgatggctcctacttcggagagatctgcctgctcacccggggccaccgcatggcgagcgtgcgggccaacacctattgccgcctcctttcgctgagcgtggacaacttcaacgaggtgctggaggagtaccccatgatgcggcgcgccttcgagacggtggccatcgaccgcctggaccgcatcggcaagaagaattccatcctcctgcacaaggtgcagcatgaccttaactcgggcgtattcaacaaccagtagaacgccatcatccaggagatcgtcaagtacgacggcgagatggtgcagcaggccgagctgggtcagcgcctgggcctcttcccgccgccgccgccgccgcaggtcacctcggccatcgccacgctgcagcaggccgtggtcatgagcttctgcccgcaggtggcgcggccgctcgtggggccgctggcgctcggctcgccgcgcctcgtgcgccgcccgcccccggggcccgcacctgccgccgcctcacccgggcccccgccccccgccagccccctgggcgcgcccgccagcccccgggcaccgcggacctcgccctacggcagcttgcccgccgccccccttgctgggaccgccctgccctcgcgccgcctgagccgcgcgttgcgcccactgtccgcctcgcagccctcgctgccccacggaacgcccgtcccagcggcctccacacgcccggccagcagctccacaccgcttctgggacccacgcccgctgcccgggccgccgcgcccagcccggatcgcagggactccgcctcacccggcgccgccagcggcctggacccccaggactccgcgcgctcgcgcctctcgtccaacttgtgaccctcgccaaccgccctgcgggcccaggagggccggaggcggggccgtcatccagaccaaagccatgccattgcgctgccccggccgccagcccgcccagaaaccacagacaagacataggtagccgtagttggactgacgggcagggccggcggggcagccccctccgcgtccccggccgtccccccttatcgccctgcgcccactcccatcgcccctgcccccggcggcggcctcgcgtgcgagggggctcccttcacctcagtgcctcagttcccctagctgtaaaacagggacggggcggcccagtggctgagaggagccggctgtggagccccgcccgccccccgccctctaggtggcccgccgtccgatgaggatcgttttttaagtgcaatacttggcccaccggcttcccgctgcccccatcgcgctcatgcaataaccgacccggccccggtccacgcgcgtcccgcggtgaccttggggagcagcaccccagctccctccagcactggcaccgaggggcgggcctggttgcgccgggcgcgggggcgaggctggggtcccgccaccgtgatgaatgtactgaccagctgaggcagcagtgcccccaccgtggcccctacgcccaattaacccccacacccccattccgcgcaatgaacgacagcatcggcaaaaaaaaaaaaaaaaaaaaagacttgaactggagaacctacttccaaggcagctaactcacatttctgggaagtaggttctgagaagtccattccttcccacacaacctcctgccccagggctgcttgagtgtcctctcagggtggtggctgacttcttccagaaatgaagagatgtaagagccagggagagccaggcagaagttacaggtccactagacaacctacagtatggcaaattacagttgcctgtttcctagaaaaatttataccagctgaagtaattacaggagatagaaaactttaatggtcctacatgaattaaatgaattacatcaactcttgaaaattaactttgacaaagtaccaaagatgtgttgctaataaattctattcaaggtacagatacttctagtcttatatcatctgtactagagaatagaaaaagaaacagaaataaatatataaaaatatgtgagaataaagcattatagtccaagctcgtttatggagagagatgcaaatatcctgaatttaaaaaaataaagtatatactttactcacagaaagcaatatacctaaaattaaatctaacatagatatgcaaaacatttatgcagaagtaaatgtagcattgtctttcaacacagaaaataaactaaaaatgaatgagtagataggcaaagtttttgtatcagaggcctaaatattatgaagatatttaataattaaatgcaattcaaatataaataccagcagggtatttcattgaaaaaagttaaatataaaatttatatgaaagtgtatagggccaagaaaaaaaaaattttggaaaagaagaactgtgcagtaaagtgttaactcagcaggcctgggctgcccaaaccctgcatattccgaagggcttcaggacagtccctgacaggctcctggagataacctctgagcctttgtaatattctgtgtgatttgagtgactttgtaaacctgaagctttgggtcacaccacatgctatcaacatgctttatagtgaacacctgtttatgtatgcctgggccttgggtcacattgtgtcactttgacctctgggggtggcagacagctgactggagactgagtggttgaggtcagtcatgtggagcacaactggaagcccatgcctcctccttagtgctggactctgctgtgtgcacctttttccttgctgcttctaatctatatcctttcactgtaattaacaatagctgtgagtctaacagctgtctgtgtcctgtgagtctttctagcaaatcgtgcactggaaccaaagtgggtgggcactcaccaactaaaactatcaaacctactaggaatctgtgaaaattaaagaacgtggcagtacatagacatagccaataggcaaaagagaatcaaaccttaagtgcaaagaaatgcattgcagatcagcaagtaagaggtaaattatgggataaagtgatccaaacactgtttattcaggaaaaatgtagatttttatcagacaccgtttataaaaatgtttcagatagattaaaacctaatagtgagcagcgaaattaagcatgtctttggaagaatgaggatcatgttcttgttctcaggatggggacagatttactaatgtagacaatcataagaaaataggtattataataatttgacaacattaaagttaaacatacctgtatgcaaaaagacaccataagccagcaaggattaggtatcatgtatctctaaccatgtgatatagctgacaggggcttagtatattcagattatacatcaatcaagttaattaatccattcaaacaaatccttattgaatgtctatgtgccaggccctgttctagtcaccagggtaactgtagaaaacaaaactaatatcctcccctcataggagaggcagacactaataaatacgtcattacatatgttgataaacctcagatttcagaaagtaccaaggagagaactaaagcaggtgggagaatagagcttcgtgagagatgggagatgctattttagattggctgttcataaaaagaataattttgaacccaatgggttatgtaaaaatcagtatagaatagaaaaatgacccaatagaaaaagacaattttcagccgggcgcggtggctcacacctgtaatcccagcactttgggaggctgagacaggtggatcagttgaggtcaggagttcgagatcagcctggccaacatggtgaaaccccgcctctagtaaaaatacaaaatttagccaggtgtggtggcacacacctatagtccctgctacttgggaggctaatgcacaagaatcgcttgaacctgggaggcggaggttgcagtaaactgtgatcttgccactacgctccagcctgggcgacaaagcaagactgtctcaaaattaaaaaaaaaaaaaaagaaaaagacaattcttgattgaatgaactgaatgcccaataaacatttgaaaagatctctgtaatgtatttaacataattttacatctctgttcatattagagaatttatggggtttttaataaaacacttggccctgagttgataatttttgaagctgggtgataggttaatggtggttgattatattattctcactctctgtctcactcattacacacacacacacacgaaatcatacatgatgatttatacagttacttatagtttacataatttatatatttaacataaatataagtataaaaataattattataaatataaattatatgaaaataatttataatgaattctaaggtaattaagacacaaataacaaattttaggactgaaacagagatatggccacagatcatacaggtattaaaaaataactagtaaatctatgaaaatctttatacaaaattatctttatactatgaaaatctttatacaaaaattgctgaaaaacagacaacttcctccaagcatatgatttattaaagtgcattcaaaaatataaagtcttcacaaccctataattataaaattgaatctgtaattaaacaatttgtcatcaagaaatgccaagtcccaaaggatttactgatgatttttaccaccaaacatttgaggaagaaataagaagtcatattacacaaatcattctagagaatagaagaagagaaaatactttccaatgagggaaagataatcttggtcacaaccaaaaccaaaataagagtatcggaaaaaataaaattgctcttgaattcttaataagttactctaaactcttgaaagacaatttctctcttgaatatgacttaaaaataaatccaagccaggcgcagtggctcatgccggtaatcccagcactttgggaggccaaggcaggcggatcacttgagtccaggagttcgagaccagcctggccaacatggtgaaaccccatgtctactaaaaatacaaaaaaattagccaggcgtggtggcgggtgcctgtaatcccagctacttgggagggtgaggcaggaggaccccttcaacctgggaggcagaggttgcagtgagccaagattgtgcaccactgcactccagccttggcaacaaagtgagactgtgtctcaaaacataaaactacaaaataaatccaaataaaaacattagcaaactgagtctagtgacatatacataaaggaaaatacatcatggtcatgttgggggccagggatacaagattagtttaacatatgaaaatcaatcaacataattctccatgaaaaaaaacattttaaaaaattgaactgtctagttatgattgttaaaaaagaaactatcactatattagaaataggaatacactttctaaatgtgagaaaggtgtttttatattgaatgaaaaaatgttgtaagagcattctcagagattagaaattaaaacaacaggatgtctgctcttaccattgttattcaacatgatactggaggtgctagtctgtgcactgaggcaagagatagccagaaaagcgtgtatcattttcaagtgccagaataatgaaaatgctcaaaaaagcaaaaaggatggggcatatcagagagatataaaagtgaccctgatataaaataaataacatggtattggcttacaacccaaagtataaaatcaatatacatgaggttacactgatataaataaatgattaaatgaacaagtaaatacaaaagaaagaagaaggacaactctttgtagaagaattccagataatatgaatagatactgtctcttccaggaattggaccttagtgtctacctcccaggccaccttgtgcctggcctggacttagtgattcacatgcaagactagagtattgaaagccgggaaagagtatctgtgtggtagagaaacctagcaaacgcctccttgaccacatgatcaaggtgaacatcaccagtaatgaggcatgttgatatcacatccccttgatatgaagtgatgagaaggaagcttaacctctgcagaattttttccaaaagctcataattccagcctaatcaggaaaaaaataatcagacaaacacaaattaaagagcattctaaggacctgaccagtaatcttcaaactgtcgatacacagtaacaaggagaggctaagagttggccacaggccagaggaacccaaggaaacgtaatgattaagtgccagatagtatcctgaactggatactgggaacagaaaaagaacgttggtgtaaaaacttagtggaatgcaaatacattactgttaatgaaaattcagaatttaatattggtttcttagttttggcaaacgtagcatggttgtgtaacatgttaactttaaggaaagctggataagataactctctttactttttttgcagcttttctgtagatctaaaattattccaaaagtaaaaagtttattacataaaagaaagaagtcacaaaactcttattttaagacttacatggcaaattaagtggccatgattaaacaagtcatattttttctatgtatgtatgtatttatttttaaaattggttaatttatacatatatatttttaaattttacttcaagttctgggatacacgtgcagaatgtgcaggtttgttacataggtatagaagtgtcatggtggtttgctgtgcctatcaacctgtcatctaggttttaagcgccgcatacattaggtatttgtcctaatgctctccctccccttgccccccacttccctacaggccccagtgtgtgatgttcccctccctgtgtccatgtgttctcattgtttaactcccacttatgagtgagaacatgcagtgtttggttttctgttcctgtgttagtttgctgagaatgatggcttctagcttcatccatgtccctgcaaaggacatgaactatatttactttttttttttttttttttttttgagacggagtttcactcttgttgcccaggctgggcaatggtgcaatcttagctcaccacaacctctgcctcctgcttcaagtgattctcctccttcagcctcccgagtagctgggattacaggtatgtgccaccacgcctggctaatttttagtagagacgaggtttctccatattggtcaggctggtcttgaactcccagcctcaggtgatccacctgccttggcctcccaaagtgctgggattacaggcgtgagctaccatgcctggcctatatttaattttaattgacaaaaaaattgtatgttaaaggtatacaaaatgatgttttgatatatgtgtacaatgtagaatgtttaaatggagctaattaatatatgcgccacctcacatacttattattgtcttgtgatgagaacttttaatatttactcccttagtgatttttaagtatacaatacattgttgttaagtacagtcaccatgttgtacaatagagctctttcagtcattcctcctgtctggctgaaaatttgtgtcctctgaccattatctccccatttcctcttctccctagcccgtggaaccaccattctgagctctactcttagaaggtttttagatttcatacgtatgtgagatcacgtgatatcttccttcctccctcccttcttccttccttcctctctttctctcttttcttttctttctttctttctctttctttcatctctctttccttcctttcttccttccttcctttctctttcatctctccttccttcctttcttccttcctttctccctctttctttcctttctttctttctttctttctttctttctttctttctttctgtcttcctccttccttccttccttccttctttcagacaaggtctcactctgtcattcaggctggagtgcagtagcgtgatcatagctcactgcagccttgaactcctgggttcaagcgatctttctgcctcagcaccctccaagtagctgggaccacaggctatatcaccatgcctgactaattttttaaattttttttttttttttgtagagacagggtctccctatgttgcccaagctggtctcaaactactgggctcaaatgatccttcctccttggcctcccaaaatgttggattgcaggtgtgagccactgcacctggttcattatttgtctttctgtgcttagcttatttcgtaaagaagtcaatattaaatattaaaagttattataaagatatattagcaagacagtatggtagggacataaatataaacacacataccaacagaacatgacaaaagaacaaaaccagccgcatgcatactcgatggagacaaaggtaacactgcagaatggtgaaggaagaacagtcattttaatgacagtgttggcttaattgagtattcatgttcaaaaaagaaatttgagccttatttcacatctcatagacacacactataacttccttgtggagtttaaatctaaatgcaataagtgagcaataaaaattttagaatatattctaacagattatattaatgatcttggtgtaggaacagattttttaaaacactatataggaaactttaaacataaaaaagattgataagttagactacactaaaatattgaatatatcttcaatgaaatacaatgtttaaataatgaaaacataaatcacagagtaggagagaatattttaagtatggcagcgaaggtcctatgcctagatgatataaagtgcttctaaaagccagtaagaaaaagactcaattaaaacattgggaaaacgtttggataggcacttcataataaaagagtattcaaatgatcaatgctcacattaaaagtggttcaacatcgttaatcatcaggaaactgcaaagtaaaccaaccaagagataacactgtatactcatcaagaggcctacattttttattttatttgcttacatttttactttagattcagggggtacatatacaggtttgttacaggggtatattgcatgatgctgaggtttgggcttctattgatcccgtcatccatgtagtgaacatactgcacgataggaagtttttagcccttctcccctctttttcctcttttggagtccccagtgtctattgttcccatctttatgctcacatatacccacaatatagctcccacttataagagaacacgtgacttttggttttctgttgatgcattaattcacttaggatggtggcctccgactgcatccatgttgctgcaagggatattattttattcttttctatggctgcatagtattccgtggtgtataggtaccacattttctttatccgatccagagttgacgggcacctggattccatgtcgttgctattatgaatagcactgcaatgaacatataagctcatgtgtcttttcagtaaaatggcttattttcctttgggcatacacccagtaataaaattgctggatcaaatggtacctcaaatcttagttctttgagaaatctccaaactgctctccatagtagctggagtaatttacattcccaccaacaatgtataaaatttcccctttctttacaacctcaccagcatctgttattttttgacttttaatattggccattctgactgatgtgagatgatatctcattgtggttttgatttgcatttctctagtgattaatgatgttgaactttttttttcatctgtttgctggccacttatatgtcttcttttgagaagtatctgttcacgtcctttgcccactttttaatggggttatttgttttttgcttgttgatttgtttaagttgcttatagatgctgctttgttggatgtacagtttgcaaatattttctctcattctgtaggttgtctgtttactgtgttgatgtttttttgttgttgtgcaaaatctctttagtttaattaaatcctactcaccaatttttgtttctgtaacagttgcttttggggacttggccaaaaattctttgccaaggccatgctaaagaaaggtattttctatgttttattctagcatttttacagtttcaggtcttacaattaagtctttaatccccctgagttaatttttgtatatgggctaagtgtccagtttcattcttctgcatattattaggcagttttccctgcaccatttgttgaatatggagtcttttccccattacttgtttctgttgactttgtcaaagatcagttggttgtaagcgtgtgaccttatttctgggttctctatactgtctcattggtctatgtgtctctttttgtaccagtaccatgctgttttggttactgtagccttgtggaatagtttaaagactttaccaaaaaactcctagacctggtaaatgacttcagtaaagcttcaggatacaaaatcagcatacacaaatcagtagcatttctatataccaatagtttttaagctgagagccaaatcaagagtgaaatcccattcaaaatagcaccaccccccaacaaattaaaatacttaggaatacatctaaccaaggaggtgaaaaatctctacaaggagaactacaaaacactactcaaagaaatcatagatgacacagaccaatggaaaaacattccatgctggtgtgttgaaagaatcaatattgttaaaatgtccatactatagattcagcattatttctatcaaattaccagtgcaatttttcacagaattagaaaaactgttctaatattcatatggaacccaaaaagagccaaagtcattctaagaaaaataaaaccagaggcatcacattacttaacttcatgatggctaaaatttaaggattgacagaaacacattatattactggtgtaggtataaattattaccattaatttggaaaactattgacagtatgtcagttttgaacaaaatcataccctatgagttagcaactccacttttgggtacacacccagaacatgattatcaaaaggcatccaagttttatttcataagcacctaaggatgtggatcaaaatgcaaatctgctacacaaaattagtagccagagggttcttggtgagtctggaagcaaagcacagcattgctttttattactcagccgtcatggcccagttgcctttggcaggtgaggccagctggccagtagctcagatggagcaggtatgagggggtaagagcagtggtccatctgtcactggagaagcctagtcacctgggcagaatatcttgaacctaggataagttcatccatggtagaccaactctgtgatggagttatgagatggggaaggagggtctggcaccatgcaacaggatttcccccaaagctcagcactccaaggagcacatcagcatcaggaatgtctgctggaagccagcggctgtggaggaggggcagtagccactgagcctaggttcagagcttcaatccccttcagtcctcttgactggcaagagaacagcagagtctattagagaggaattaccattccaagcaagaatttaggccacatctttcagaatgagaccattgagttgaggtccacttagcagggaaagtggcttcaggttgtggttgactgtttaattacaccctgctgttcactctcttcaccattgtatgcaaagtacagcgtctctgacaagcaaggaacactggcttgccccacagtggctggctggggttgatgaaatgagcagcgaagtagcagtgtgcccagtccaagcagagactacctctagcaggggcatgacattccccaagagagggcatctcctttagcctggaccttggagcaaaagcaacccatggatcagaccaatagacaacatgcagccctcatctaacccaagtggaatatagctgttggtataagcccccgagattttgaggttgtccccacaggaaagcaaactagcataacactgaattgctgagcaagtgggtggttaattaatagctctctttcccaactagagcttccctgaaagtccgaggaggcctggagcatgcagggagaggacaagcagcctcggagagaaagaggggaggtacaagtgacctggatgcaacacggcctggcccaggaggaattggatactcttaagggatatttcacacaagtcatatgaatctggaagactaccccagatccatataggtatataggacaaggccagactactctctatccccaacatgtctctcaactggagagtactaataaatactgccaattcttactacccaattcctgttttaatcagttataaaatacaatttagtatattgccgtggatttttatattggtaatattttcctaaggtggcttgccaattatcccagccccatttgttgaatagggtgtcctttccccactttatgtttttgtttgctttgttgaagatcagttggctgtaagtatttggctttatttctgggttctctattctgttccattggtctatatgcctgtttttataccagtaccatgctgttttggtgactatggccttagggtatatcagttgatacctccagatttgttctttttgcttagtctttctttggctacgtgggctcttttttggttccatatgaattttaggattgttttttctagttctgtgaagaacgatggtatgttttgatgggaattgcattgaatttgtagattgcttttggcaatacggtcattttcacaacattgattctacccatccacgagcgtgggatgtgttttcatttgtttgtgtcatctgtgatttctttcagcagtgttttgtagcttttcttgtagaggtcttttacctccttggttaggtatattcctaagtttttttttttgttttgttttcagctattgtaaaaggggatgagttcttgatttgattctcaggttggttgctgttggtgtatagtagagctaccgatttgtgtacaataaatttgtatcctaaaactttgctcaattcatttatcagttctaggagctttttggagaagtctttggggttttctaggtatataatcatatcatcagcaaacaacaacagtttgacttcctctttagccatttggatgccctttatttccttctcttgtctgattactttggctaggactttcagtactgtggtgaatagaagtggtgaaagtgggcatccttgtcttgttccagttctcaggaggaatgctttcagctcatcccccttcagtattatgttggctgtgggtttgttgtagatggcttttgttaccttgtgtcccttctatgctgattttgctgagggctttaatcattaagggatgcttaatgtcaaatgctttttctgcgtctatcgagataatcatgtaatttttgtttttaatcctgtttatgtggtgtattgcatttattgacttgcatagtgttagtggctctttctgcatacttgagaatatctagttttatgtctcgtttgaatctgggtaggttacttaaccatgatgacagttcattattatattttattttaaaaatgtattttttaaattttaaaatatttaattgacaaagattgaatatttttggtgtgcaacatgatgatttgacatatgtatgcattgtgtagtgattaccaaaatcaaattaattaacacatccatcaccacccatgctgtatatgagaaccccagaactgattcgtcttgtaactgaaagcttgtattctttgtccagcctctcacccagtttcccctctcccccacccctggcatcaccatttaactctctgcttctatgagtttgacacttttatttatttatttatttttgagacagatttttgctcttgtcgcccaggctagagtgcaatgtcacagtctgagctcactgtaacctctgcctcccgggttcaagtgattctcctgcctcaacctcccgagtagctgggattacaggcatggcatgtgccaccacacccagctaattttgtaattttagtagggatggggtttcaccatgttggtcaggctcctcttgaactcctgacctcaggtgatccacctgcctcggcctcccaaagtgctgggattacaggtgtgagccaccatgccctgcccagtttgacacttttagattccacacataagtgagatcatgcagtatttgtctgtctgtgtctttctatgcttattttatgtaacatgtcctccaggttcatctgtgttgttgcaaatggcaggattttctttttatggctgaataatagtccactttatacttcaaattcttcctatctttcagaaccagatccaatgccatctcttccgcaaagccttctttgatcttgaagtttggcagaggaagttctccccactgtgaggtttaattatattgatttcctcctggccatgggtctgtttgtaatagggatttatgcaggagatagataaggtttctcatgcagcttgtcagctggtatcatagagtgttttctgtagttattattctataactatttatttatgttttataagtcctatgaaatatcacttaaaggaaaattctctcagccttgttcccaaattctgtgtgatcacaaagacactattgctttctaggccttgctttcatggaactgaacctaaatagtgtaccttttttaggtatctccagggtctttctttaactatttttgctcaagtaaaagtgaatagcaaaaatggagtattttaaacctgaaaaaaaaaaaaaaacagaaaggaagtgaggtggcttgacttcctcctaagtttatagtaagtatattttctcatgggaagaaaaaaacacactgatgattagaaacactttgctttttgttcagccacaacctagctatttcccacaaaattaatccactgttaccagaatagggaagcatctgtacacatagagagaaatggaacctaaatatttctggaaacctcaagtcacttacacattccacaagttgcctcatatcgagaaacacagaatttgttcaaacatttcaatacttcaccagattgagtttgcaaacaaaaacattttggaattgtggcaaagggagtggctgtcatggcagaggtgagctcagacatgtggattagtattcagacgataatttggctccagaaatcatcaccacggggcacacaaccctgtagtcagaaaggacctcatgaatcaccccatagattaccctaaaatttaaagattttctccagaatgaacctagtaaagaagactattctaagaggcagcttatctcattctgaaaacatctttgttgtttctttctttcttttctttttttttttttttttttttgagatggagtctagctctgtcccccaggctggagtgcagtggcgcaatctcggctcactgcaagctctgcctcctgggttcacgccattctcctgcctcagcatcccgagtagctgggactacaggcgcccgccaccacgactggttaattttttgtagttttagcagagacggggtttcaccgtgttagccaggatggtcttgatctcctgaccttgtgatcctcctgccttggcctcccaaagtgccgggattacaggcatcagccactgcgcctggcctgtttatctttatttctttttttttttcttttattattatactttaagttttagggtacatgtgcacattgtgcaggttatttacatatgtatacatgtgccatgctggtgcgctgcacccactaacttatcatctagcattaggtatatctcccaatgctatccctcccccctcctcccaccccacaacagtccccagagtgtgatgttccccttcctgtgtccatgtgatctcattgttcaattcccacctgtaagtgagaatatgcggtgtttggttttttgttcttgcgatagtttactgagaatgatgatttccagtttcatccatgtccctgcaaaggacatgaactcatcattttttatggctgcatagtattccatggtgtatatgtgccacattttcttaatccagtctatcattgttggacatttggcttggttccaagtctttgctattgtgaataatgccgcaataaacatacgtgtgcatgtgtctttatagcagcatgatttatagtcctttgggtatatacccagtaatgggatggctgggtcaaatggtatttctagttctagatctctgaggaatcgccacactgacttccacaatggttgaactggtttacagtcccaccaacagtgtaaaagtgttcctatttctccacatcctctccagcacctgttgtttcctgactttttaatgattgccattttaactggtgtgagatggtatctcattgtggttttgatttgcatttctctgatggccagtgatgatgagcattttttcatgtgttttttggctgcataaatgtcttcttttgagaactgtctgttcatgtcctttgcccactttttgatggggttgtttgtttttttcttgtaaatttgtttgagttcattgtagattctggatattagccctttgtcagatgagtagcttgcgaaaattttctctcattttgtaggttgcctgttcactctaatggtagtttgttttgctgtgcagaagctctttagtttaattagatcccatttgtcaattttggcttttgttgccattgcttttggtgttttagacatgaagtccttgcccatgcctatgtcctgaatggtaatgcctaggttttcttctagggcttttatggttttaggtctaacatttaagtctttaatccatcttgaattgatttttgtataaggtgtaaggaagggatccagtttcagctttctacatatggctagccagttttcccagcaccattcattaaatagggaatcctttccccattgcttgtttttctcaggtttgtcaaagatcagatagttttagatatgcggcgttatttctgagggctctgttctgttccattgatctatatctctgttttggtaccagtaccatgctgttttggttactgtagccttgtagtatagtttgaagtcaggtagcgtgacgcctccagctttgttcttttggcttaggattgacttggtgatgcaggctcttttttggttccatatgaactttaaagtagttttttccaattctgtgaagaaagtcattgatagcctgatggggatggcattgaatctgtaaattaccttgggtagtatggccattttcacgatattgattcttcctacccataagcatggaatgttcttccatttgtttgtatcctcttttatttccttgagcagtggtttgtagttctccttgaagaggtccttcacatcccttgtaaggtggattcctaggtattttattctctttgaagcaattgtgaatgggagttcactcatgatttggctctctgtttgtctgttgttgctgtataagaatgcttgtgatttttgtacattgattttgtatcctgagactttgctgaagttgcttatcagcttaaggagattttgggctgagacagtggggttttctagatatacaatcatgtcatctgcaaacagggacaatttgacttcctcttttcctaattgaataccctttctttctttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatatacgtcccatcaatacctaatttattgagagtttttagcatgaagggttgttgaattttgtcaaaggccttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtctgccagtattttattgaggatttttgcatcaatgttcatcaaggatattggtctaaaattctcttttttggttgtgtctctgcctggctttggtatcagaatgacgctggcctcataaaatgagttagggaggattccctctttttctattgattggaatagtttcagaaggaatggtaccagttcctccttgtacttctggtagaattcgcctgtgaatccatctcgttctggactctttttggttggtaagctattgattattgccacaatttcagctcctgttattgtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgagatcccctttatcattttttattgcatctatttgattcttctctctttttttctttattagtcttgctagcggtctatcaattttgttgatcttttcaaaaaactagctcctggattcattaattctttgaagggttttttatgtctctatttccttcagttctgctctgattttagttatttcttgccttctgctagcttttgaatgtgtttgctcttgcttttctagttcttttaattgcgatgttagggtgtcaattttggatctttcctgctttctcttgtgggcatttagtgctataaatttccctgtacacactgctttgaatgcgtcgcagagattctggtatgttgtgtctttgttctcgttggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagacagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtctgcttggtgcagagctgagttgaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtgttgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagattttcctccatccttttattttgagcctatgtgtgtctctgcacgtgagatgggtttgctgaatacagcacactgatggatcttgactctttatccaatttgccagtctgcgtcttttaattggagcatttagtccatttacatttaaagttaatattgttatgtgtgaatttgatcctgtcattatgatgttagctggttattttgctcgttagttgatgcagtttcttcctagtctcgatggtctttacattttggcatgattttgcagcggctggtaccggttgttcctttccatatttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgagaattatgtgtcttggagttgctcttctcgaggaatatctttgtggcgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcacttcatttcattcatttcatcttccattgctgataccctttcttccagttgatcgcgtcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcctgtagctcagagtaatttgatcgtctgaagccttcttctctcagctcgtcaaagtcattctccgtccagctttgttccattgctggtgaggaactgcgttcctttggaggaggagaggcgctctgctttttagagtttccagtttttctgttctgttttttccccatctttgtggttttatctacttttggtctttgacaatagcgatgtacagatgggtttttggtgtggatgtcctttctgtttgttagttttccttctaacaaacaggaccctcagctgcaggtctgttggagtaccctgcagtgtgaggtgtcagtgtgcccctgctggggggtgcctcccagttaggctgctcgggggtcaggggtcagggacgcacttgaggaggcagtctgcccgttcttagatctccagctgcgtgctgggagaacgactgctctcttcaaagctgtcagacagggacatttaagtctgcagaggttactgctgtctttttgtttgtctgtgccctgcccccagaggtgtagcctacagaggcaggcaggcaggcctccttgagctgtggtgggctccacccagttcgagcttcccagctgctttgtttacctaatcaagccttggcaatggcaggcgcccctcccccagcctcgctgccgccttgcagtttgatctcagactgctgtgctagcaatcagcgagactccgtggtcgtaggaccctccgagccaggtgcaggatataatctcctggtgcgccgttttttaagcccgtaggaaaagcgcagtattcgggtgggagtggcctgattttccaggtgctgtccgtcacccctttctttgactaggaaagggaactccctgaccccttgcgcttcccgagtgaggcagtgcctcgccctgcttcggctggcgcacggtgcacgcacccactgacctgcgcccactgtctggcactccctagtgagatgaacctggtacctcagatggaaatgcagaaatcacctgtcttctgcgttgctcacgctgggagctgtagaccggagctgttcctattcggccatcttggctcctctctctatctttatttcttataacttgttttaatcatcctgtttgggactcgtagctctgacatttggtgatattaagaacacagggattacttattcacaggctgtgatatcacatagtggaaaacctttattatttatgactcctgggataaatattccaggtttctacacacaagatgattttcatgttttctgccatctgtattataccctctttgtcaatatcatccttaaaatgagctgccctgctcccagcaaaatgactcatctagcaatgcttatatgagattcctgaatgcattactatgacagggtcacatctcaatttcatttttctctttataaaaggaatttataatctttcccagattataaattgtcaattaacagaactaataaaaattattttaaaagtatgtatataagtaactgctacaagcattttcaacaatgatgaacatgagaaaagctatcctattctctggagttaaatatttattttgaaatattaagatatttctaatttttcaaatccattgataatatatcattatctgatgggaaaattttcaatagatataaatgtatttagaatgtaaaaatgaattcagaatggaataataattctacttatagtagtattcacagagaaagtagaactattgccaccttttaattgggtggtagatttcaattgttctcactgttttggcagccttgtcacaggattccttatgtgaggttttatttgcctaaatctcattccttcctcacatgagtcatcaccaagccaggaatcttttgtaccttgcaagcgactttctggaatacaggctatcaaactttttcctaataaattttatttcatttttctgtagctcctcattcttatctgtcaatgtcattttacaagtcttgaagctgtcttctacagcagagctgcaaatctgtttccacttgagcttctgataaacatactaaacaatatatgctgatgacccaacattcagaatcacctttcaatttgacacagacctggtagtaatactctttagagatctagtttaggatctctaaacccaggaaatcacttgggttgatctctaaacccaggcaaattctctttacccaggaaattcactaatctatcaagatacagacacagtgtcaagtactcggctgaagtagagatacataccacactctgttctaaagggcaataacagttttttttccccattagaacggacttactcctggtaaacctggagctgtaaagctgatacgtaggaatcattcaacaaagtgtacgcattagtattattgttatcagtttgtattaatcaatacactatcctctaaatgctcccaaattcattgtttaaaaactagataaggggttgggttaagataataagtccttattttctggaacgaggaaactagttaaggttaacttcagtttggtcatctggtaccacagaaaaatctaacaccacagagacactgggtcatatgcagagatttattcttaatatttcctaactgaaaaacagctcattaggcacatctggagaccttggagctgtcctaggtacaagggtggggtggcagagaaaagcttaatgtagactctctactctcaaacgactcattctggtgaatagacactagttaactatgcaggtaaagttttcttcattcttgtatctcaacatctgacacagaccctggcttggtaacgggaactcacatgtgtgtgatgaaggtaaggagcactccgaagagagcctggtgatgcagaactagcaggcatgtggtgcatcccaattcccctagtgcttcaaagtccttacaaagcagaaccgtggccccgatgtgaggcacacaggctggggacacaattccttttcaaagagaagcaactgaatgctcagaagtagagtgacttgtgaagggtcactgggaagaacgtggcaaagctgaaatgaacactcagatctgcagactataagtcatttgcagggccaggcatggtggctcatgtctattatcccagtgctttgggaggccaaagcaggaggatctcttgtggccaggagtttgagactggcctgggaaacatagcaagacctgtctctacaaaaaatataatagaaaattcaccaggcattgtgctgtgtgcctatagtcctagccactgaggaagctcaggctggaggattgcttgagcccagaagtttgaggctgaactgagctatgatcatggcactgcactccagcctgggtgacagagtgaaatcccacctctaaaaagaggggaaaaaatagctttttttttttttttttcctgagatggagttttgctctgtcgcccaggctggagtgcaacggcacgatcttggctcactgaaacttttgcctcccgggttcaaggaattctcctgcctcagcctttcgagtagctgagattacaggcacccaccagcacaccaggttaattttttttttttgatagagacggggtttcaccatgttgttcaggctggtcttgaactcctgacctcaggtcatccgcctgccttggcctcccaaagtgctgggattacaggagtgagccactgcacctggctggaaaaaatagtcttaactatagtcccagctacttgggaggcagaggtggtaggatcgcttgagcccgggaggtcgaggatgaagtgagctgagatcgcaccactgcactccagcctgggaggcaaagtgaaaacctatttaaaaaaaaaagtggtgacttcaaatcactctctttcagcattagagtaaggtaggaagtctgcatatttttagattctcatgatttttctcatggaaggggtgatcatttctgatcactgccattgcatcatgacaacaaagctgcttctgtgtgtcctagaatacaaaatgcaaatggaatccagcctggtaaaaatgtggaaggagagcaagaagccctttggtgagcatagccaggccacccatttaggttgtgttggtgcacatccttgcaggccccatgcacatcacaacttccacagactcacatgtgctttacaacagttctctagaagatggtagtaggagatcttattctaacaaaacagtgtaatatgacagcatcccaagagatagaagtaacatgtcttgagaaagaagtgcctcttttctaatcttcatggagacagctcatggactgtgattgctttgcatccagtctctccagatgacctattgctctcaaatatcactaatgactgactacaagccaacaagagagagggttgagtttcatgtatcttgtgcagagtaggtgctgagttaatatttctcgaattcagagttgtgctaggtctcccaagaatttcataatgtaatgctgaagagcatgggctttggggtcaggcaagctaaggttcaaactttgactactgcttaggatactagaataagttctacatcttcattgtcctcatggaaagattcatggtcctcacgggtaaaatgtgatgaataaaatctgcaggactgggaggagtaaaggatataaataatattgcattccatgcctggtacgtagttggtgctgtcgacagtagctagagagagagaaatgaatgatggtaaagagtgcaggctactctacctgtacccatgttcatcatagcactatccacaacagccagaatatggaatcaacctccgtgtccatcgacaggtgaagaaaatgtgttataaatacacggttgagtactattcagccttaagaaacaaggaaatcctgtcatttgcaacaccatagatgaacctggaggacattatgctaagcgaaataagctgggtgccaaaagacagctactttatgatctcacttatatacagaggctaaaaatgtcaaactcacagaggcagagagtgggatggtgcttaccagaggctggggcaggggaaggactgagaagaggttggccagggatacacaatttcagttaggaggagaaacttcaagaaatctgttgcacagcatggtgaccacagctaaacacagtgtcttgtattcttgagcacttctaagagagtagttttaagtgttcttaccacaaataactggcaagtaggtgaggcaatgcatatgttacttagttcagtttagccattccatagtgtacgcatactgtatatcaaaacactatgttcttcttaggacaggcgatgaggacaaaaaaagaaaaaacattatgtcatataccataaatatatacagttcgtgtccgtcaattaaaaaaaaaattatggctgggtgcagtggctcacgcctgtaatcccagcacttcaggaggccgagatgggcgaatcacctgaggttgcgagtttgagaccagcctgaccaacatggagaaaccccgtctctactaaaaatacaaaattagccgggcgtggtggtgcacaactataatcccagctacttgggaggctgaggcaggagaatcacttgaacctgggaggcggaggtggggtgagccgagatcgcactattgcactccagcctgggcgacagagcgagactccttctcaataaataaataaataaataagtaaaaatttacaaacagagcacagactgtggagtccagctgcctggagtcaaggccaagcttgtctctacttagctgtgtggcatttacacaggtccctgaagctctccatgccgcattttctcttctgtaaaagtcttttggggaggtaaatgacagaacacatgtatgggggtcgttgctgctggcacctaatatttctgatccttaggcacagcctgctccccttcaaatcaggcctggccttgggattgtgctttggcttgtggtatctgtttgttcacttctggctggagcttcaggagacagcgtgtgatttgatatttctctttatctgccaggtagtgcaaaatgacatacagcacagcctggccagtccaaaactgacacatagtaccataaaatcttctgggactttgtcggtttaggtcccagaaaatattgatgatattttattattgcaatatggcctcccccatctttttttttttgtgacagagtctcactctgtcacccaggctagagtgcagtggcgtgatcttggctcactgcaagctccacctcccgggttcaagtgattctcccgctttagactccagagtagctgggattacaggagcacactgccacacctggctaattttttagtgtttttattagagatggggtttcaccatgttggccagactggtctcgaactcctgacctcaggcaatccacctgcctcggcctcccaaagtgctgggattacagaagtgagccagcacgcccggccagcctcccccatcttaaggaaaacagaatctaaagtgcccaaactcgtgtctggcccatagttggtactcagcaaatgtttattattgttataataataatgattattcctgtcatcattcctaatgatgttcatatttgaacagccccagctctgcctagctacaccttggccattgttggacttcatgattttaagatctctcttctctagaagaaacagtttagtatttggcacaagagaaacacagaaaactacttcaaacatctattgactgactgtggatgcatctgaaagtgattcatctctgagtctttatttcattatctgtacaatggagatgaatcctaatgactgagaagtttggtcacaagcaaacttcttttggctgcagtgcctgggacaaggtcagcactagccactcctgtccgtgctatctcctttgcagcaccaatcccagctcctccagccttcacatcctagtctctcaccagctataagacttttctttctcctaattgttggctgttccacagggagatggagaggagcttgctcacttgttaattttgctattgatagcttgaggaaaaaattacatctagtaggagactctaatcagaatatctgtggaatttaggtagctccatcatttctagtccacaaatgtagctatgaaacattggaatcctttatggttttagaacgacctaatgcatttggtgtctgtggctatgtgtagctcaacaatgttgtagcctgtactcacacttagctataccaggtgatcattttcccactgtcttggcttttctgggaagacctgctcaatgctgctacgggcacacgcaggtggacaggtcacgacctaggagtcactgctctcagccaaatgtcacatgtaattgtgtcccaacatcctcctgaaaggagcctttcaaataactgaaaaaaactaattaaatacgtatagcatgaatcatttctggaagataactaaacccaagcagttacgccagttggtcttcatcatagttccttaatttaatagtaatcttcataggaaattgtggtatcacgtgaggtggatctggcaagctttttcatccggttccagatggggaacttaattgatctcaaatttgctcactgagctttaaagtgtggaaaaagacccagagccctgactttccagccaagtctcaggtccccaccactgggccacatacccttcccaggggccagcagaggaaatagaactcaatttgtgttaaaggtttacaaacctgttaatgctttttgttcagtatttcaaaatttagagaacatggtgctgcacattttaaggaatattacttttcttccttccctcctgcatcctgttttctctcggtgctattatggttcacattggttggcaatacattgcagcaagaaaggtattaaaagcttgaggtggtaaaactataaagttaccagctttccatgctaattcgtgtgaaaacatgatgcgctccacatctttcatggtgcaataacataggtgagtcaacatcaggcacgtgagtttgttcaagcaagtcatttgaagtcagaatggtaacttgtggaggcggatctgtgacatgctgggaagaagtcaggtttagtataccatattgcagtttattatccatgaagtagattacccaaaaaacttagccattttgcagtatgtataaaacgtgcctttattcagcaattcagtttctaagaattccttctaaataaataaggatgtgtacagatatatagatgtaaagatggttattgtaatttctttaggataatcaaatcatggtacatctgaactgaatcatcctgcattcattaaaacagcagtgctgggatttcatcatttatataaatatggaaaattcatttaagtactaagcaggttgcagagcagcaaagatgtcattatttttacttttgagcaagtgaagatggagagacagacccacagtcagaagcacatatttccaggtatccgtaattttgtaattttcattttccttttacctatatttcataattattctgtatgtaacgtgggttatttgcatcatcaaaatgcctttcaaaataatgtgtaaaaacagtattaattgcctttttaaaaaattattattatactttaagttttagggtacatgtgcacaatgtgcaggttagttacatatgtatacatgtgccatgctggtgtgctgcacccattaactcgtcatttagcattaggtatatctcctaatgctatccctcccccctcccccgaccccacaacagtccccagagtgtgatgttccccttcctgtgtccatgtgttctcattgttcaattcccatctatgagtgagaacatgtggtgtttgtttttttgtccttgcgatagtttactgagaatgatgatttccaatttcatccatgtccctacaaaggacaagaacttatcattttttatggctgcatagtattccatggtgtatatgtgccacattttcttaatccagtctatcattgttggacatttgggttggttccaagtctttgctattgtgaataaaaaatatggaacgcttcacgaatttgcgtgtcatccttgctcaggggccatgctaatcttctctgtatcgttccaattttagtatatgtgctgccgaagcgagcactaattgccttttttttcttggactgagtttgctaacatctgtgacataaggttaaagatgcaccatttagtgtcattttgcccccaactcactctgtgacaacttttggtgccatgaatttccagagggtgggatgcacgtcttgctaactgcagcatcaccccaacagagcagctcatggttattggcctgaaatgggaattttgattaggaactaaggaaagggcatctcatttcctagctgtgagcttctggacagtggggctgtgtcttttgtcatctttgggctcctgttctcctttccactgaaacatgggccagtggctacctggtagcagtcactcagaagtgtgatccagatctcattgtgggtggggagatcgaggcacataaagatgaagtggcctgtccccaggcgcatagcacctgcccctgctccactcacagatactgggcgttctgtgctaacaggggcaccttctgggcaagaggatgaggggagcactgaacacctctctcaagagaaattttttttcttctgtcacacatgcatacaaacaacaaccgatgagcttgtggtttgtcttcaaggttcaggaagactcaacttttccagcagaaaggacaatgatgcctcaacagagccggatgactctcgatggccatgccacttaacaaagcgtggccacccacttgttcacctgcagcctgaggaaaggaacagctgcaacacctgccagggacttaggggatgaagccctggaggctgatcagatatcctcctctggaggtggagccacatggctaatacgccactggacacagatgtgtgcagttttgtgtttgctgtgggctgtgatgcaaatcgcattttgtagtccccatctttggagatgctccagacagtccctcggagaaagacagaaatggatccctttgttctttctgttctttccaggcaacctgcctctgaggggaagagggcccagacataggatgctggtaagcaactactgtaattgtcagcgtaaggggctggaactcaggttccatcctgcacacttgcacaagcccaccaatgggatcaaagatgaagggtggcagcgattggagaggtcaggataagaagattcaagatgccagaaatctgcaacatgagatacagcccaggctctgggctcgttcctccagggctgcgtcgctgcgtagctgatgtggcctgtgagctgggcctcaaaggacattgcatttaaagcagaggagaggaggaaatttttgggagataagatgggatttacagagacaccaaaagagcaaaagaaaataattcctgatggtctgagcacatagagagtcaccgtggaggagactggacattggtacatatcctacaatgcctgccccatggctctggcctcatgccatgccatgcaacatggcacctggcatctcagtcaacagatgtcccagatctcagtcgttggcatttattaccaaattattctgccatcttatattcaagtccttccaaagcctttcttgttgtgggagggggagaatcttattttttaaattttattttagttattttatgtatataagttgtacatcatgatggattttttaaatacatttaattgtgtatgtttaaggtaagcatcatgatgtttatatatatatatgtgtatatatatatgtatgtatatatatatatatatatatatatatatagtaaattggttaatatagtgaagcaaattaatgtacccatgttttgtgtgtggggctgaagtatctacaatcaactcatttagcaaaaatcctgaatacaagacactgttagtattggcggtcctcatgttttacattagatctctagacttgtccgccctctttatctgcgactttgtaacccttgacctacttctctgcaattccttcctgccacactgcccctggtaaccacggtgtaattctctatttctgtatatttgaatttgtttaaaagattttacatatgagtgagattatgcaatatttttccttctgcatctgacatatttacttagcataatgtcttgcaattccatccatgttgtggcaaatggcaggatctccttttttgaggctgaaggatattcctttgtacatatatatcacagtttctttacccatttgcctgccaatgaacatttaggttgtttcttatcttagatattgagaataatgctggaatggacatgacagtgaagatatctccctgagtgctgatttcctttcctttggatgcatacccagaggaggaattgctacatcttgtggtacttctaactttaatttctttaggaagctccacttgctggtgtcaggtgataatgcataatggttttgatttgcatttccctgaggattagtgacattgagcatcttttcattaacctgtgggtcattttgatgtcttctttggataaataactattcagataatttgcccattttttaattgggttatatgttttttgctattgagctgtgtgaacattttataaattttggatattaaaccttatcaaatatatgtcttgcaattatttttccaatctataggttactttttcattttgttgattgttttctttgctgtgcagaagcttttcagtttgacatattcccatttatttatttttgcttttgtagccttttggtgtgatattcaaaaattattgccaagggcaatgtcaaggacctgttctcctatgttttctccttggagttttatggtttcagattttacatttaggtcttgtatccattttgagttgatttttgtgtatggtacaagggcccagttttattcttttgcgcatgcaaatccagtttccccagcatcatttattgaagagattatccttttcccattttgtcttcttggtgcctttgtcaaaaattagtttactgtatatatatatatagatttattttggggctctctcttttgttccactggtctgtggtctgattttatgccagtatcatagtgttttgattgttatagctttgcaatctaatttaactcaggaagtgtgataactccaatgtcattttctcttctcaaaattacttttattatttagtttttttatggttccatacaaatttcaggattttttaaatttctgtgaagaatgccatcgggattttgataaggatgccattgaatctgcatattcctttgggtaatatggacattttaacaacatcaagttttcagatccatgaatatgggttatctttccacgtatttgtgtcttctattaattttatcaatggtttataattttcagtgtacatgtcttttacttccatggttaaacttattcctaactgtatttttgatgctttcataaatacaatcgtttccttgatttctttttcacgtaggttgttatttgtgcacataaatgcaactgattttgtatcctttaactttaccaagtttgttttttagttctaacattttttttttttggtggagtctttggggtttactaaatatgggatcatgccatccatagagataatctgagttttttctttctgatttaaatgccttttatttctttttcttgtctaattgctcttgctagtatttccagtaccacgctgaatagaagcagcaagagtgggcatccttgccttgtaccagatcttagcggaaaagctttaatttttttcccattgactatgatgttaactgtggctttttcatagccttttttatgatgacaaactttccatttatacctaaactgttgagagtttaaatcaagaaacaatgttgaacttcgttgaatgctttttctgcatcaattgagatgatcatgtgatttttatctttcagtctgttaatgtatcacattgattaattagtatatgttaaatgagggtccatgtcagtgataaatttcacttgatcatgatgtataatattgtgatgtgttgttgaatttggtttgctaatattttattgtgtttttttcatcaatattttcagcgatattggcctgtagttttcttttcttacagtatctgtctggcttaggtatcagggtgatcctgcactcatagaatgtgttaggaagtattccctctaggtgtattttttggaagaatttaggaaatgttggtattaatttgtcattgaatgtttgaaggaatttagttgcaaaaccatttgattctgggctttttgttgttgtcgtacttgttatgaaatttttaattactactctgatctttttatttgttattggtctgtgtaggctttttatttcttcctaattcaattttggtaggttaaatttttcttggagtttgtctgtttcccttagggtatccaatttgttggcataatattgttcacaatagtcctttatgatcctttttatttctgaggcatctgttgtaatgtccttccttttatttctggttttatttatttgaggcttttctctttttttttttttaagtttacctcagggtctgtcgattttgtttgtttgtttttaaactaactcttagttttattgatttcttctatggttttttattctattttgatttatttctgttctgatatttgttattcccttccttcttgtaactttgggcttgctttgttcattttttagctccttgaggtgtaatgttaggctatttatttggggccatcttctcttttaatgtaggtatttattgatcagtactcttaagaatcttaactttggtggtgcatacatgaacttaacatgggtggtaaatttatctagaactaaacgcgcctaaatacatacacagacacacagataagtataagtaacactggagaaatctgaacaaaatcagtgaattgtatccatgtcaatattctggtgtgatatactaaaatggttattgctgggggaaggtgagttaaatatacctaggatttccctgtattattgtttgcaactgcatataaatcaacagttatctcaataataagttcaattaaaaaaccaaaattttatgcatatatcaatatgacatgcttaaaagaagacttgtaaatttgcctttgcagaaggagggaaaggtcgtgagtgattcccacttctcttggaaaggcccatagttagcccatattctctgagcccacatgcagtgtgctattcacatcccaataatgccgattgataaatgacacacagtttttatactttttactcgagacttttacaaggataagcttagctgaattgtacaataacattgtaaattaagctatttgaactttattttacaagaaagcaaaagtgttgcaaaatgccttgctaaatgcccacagatggtgaatgataaggagttaaacatagctgtttgctccaagtccagagctctaagctgcttgtactgtctcagccccattctttttttttttttttttttgagacagagtcttgctctgtcacccaggctggagtacagtggtgcaatcttggctcactgcaacctccatctcccgggttcgaaaaattctcctgtctcagcctcctgagtagctgggattacaggcatgtccaccatgcctggctaatttttgtatttttagtagagagagggtttcaccatgttgggcaggctggtctcaaactcctgacctcatgatctgtcctccttggcctcacaaagtgctgggccacacccagcccagccccattcttaacaagagatcctattgcccagattcaaaggctctgtgggaaacaaggataccatttacagtactggtgaaaatacagaacgtttctctttcttaagccttgtatagtcaccacccccacattcatgcctgccgccagccttggttgttgataatgccatgaacactaggctcaggccatagagctgtgcgggctctaagcaatgcccactcctgagatggggcttatcagctgcagagacctccttgtccgggtttggaaaattccaagggtcagagtgcaactgaactttttcttttgcaatttgcacctgtgggtcctagtgctacctctggagttagcacttctttcgtatgccagttctcccagggtctgctggcagtgtgctggaagtggctggtgctgcggggcagctgtgggcagaggaccaggggagccactcctcctggtacactgggagatggaggtgacagcctgagctatatgggttcccttagcagctgacacattctcatctcaacccaacaaggatgaaagatctacctttggggaaaggtgatggaatcatagcaatgatgttctaggaatccagtttcttcatatttgagaaaatgacttacatgtgcaaaaatgtctatgctggaaataatacagctttatacaatatagcactctgatttgaagaaccttgccctgcattctcttgtgtgaacctgcccacagccatgtgacacgagccaggcagcactcttgcatttagaacttggcagagataaaaatgaggctccacacctaatgctttccttcagtactggattcagccgcttcacttatttttttctgccaaaacaccactgtattttcagcctcccaggtacggggacgaatttaaggctgcctgcccagtagacagtttagtgtggggtaaatagcaccattctagcttcatggcttccccgagcccatcctgctctgcccccggctggccgcctgtcgttccagcctcgccctgtttccctccgtcccctctttagcacttgttctcttggtcctcatctttcttccaggagggcatgtcctgggtccctgtgcctaggatctgtttccctttcctgcactgccctttctcctggctcttcttttccgtcgccctccccctcctaccagcttgctccttgccttagacacagacattgacaggtccagcgaagagcgcctttgctgcagcccagtgtgtccagatcttcccgcacctgtgccgcctggcgctgctgaggcagggactcccgtctccccaggagctacctggaggaggctcagaatccatcctaaggagtttgatgacatatgtgccagatcgtgtagaggtgtccaggtatgccccaccatgtggaccgtaacacagacacgcgggatggatggacgcgtccccccttggaagtgtccagagagtgccaagggcaggctctccatcctcgctgggagcatagccagcgccacacacagaggccaggtctcagctcagcctgggagcgcccggttctttttactgctctgtctgcctccctttctgagtgtaacagttcctctccttccttcttcacctcttccaatctgtcccaaacaccagcttccccagggattcacgtcccaaatccttaaccaccacatgggacaagcatcaaccccgacacgaatcaagcagaatccgtaccaaccaggaccccagaggtcccttcaggacctcagggagtagggctgggtcgggggtgtcttgaggaaagccagggtgacccgaggccctgggggaatctcagtcttgtaaaaaagcggcttggccacagctgtggttaccactcatctctcatgagcgctctcatcatgcctccctactttcctccttccgcgagtctgcaggaagggttttctaggcccctttgcccatttcccatccactcggcctcagcacagcccgtagcggccaccagagggcgcccctctcctgcagctccgcatccccgcacagctgaagtccagccaagccctggccttggaagacccttctgctttctaacctgacagaggcgcgtggaggtgggggggccctcagagctgcagaatggacaaaaactcaaaaagggtgtgaatttcgccatgaggtccgggttcctggggcttcgctgttgttctgtttattttacccgaaccctcctataccatctgtatgagaaaatattctcaaatattgaatcatgtaggactttttttttcttttaaaggatttgatatgttaatgggttaatttgggcagagatacctccatctccaatccccttctgtcaataacagctctagttaccatgagaacttttgggcttttcttaaacagcccattctcctgttcaatctttttggtaatcaaaatagcctccaaagggcattcttttaaaatcccataagatccttcatcacttttgtcaccatagaaataataaacacataaataaccctccaaaggcaaaaaatttatcaaaaatgagatatcagaaatataaaaattcagtggctcttggtcagctggtgctggaagacccgtggcttacagaagagagaagggacctctgaagttctgcacagttgttgaaaagccagatgcaaaatctgtacctaagactggtgcgtgagagactcacgttcctccatttcgaatctggttaacttgctatgattgagaagctcgctcacaaatcctcaccctctcattcctatcctttctggattgagtgaaagattttcaggttgtgaaggctgaagaaaatggctgctgacttcacaacctgtttcagccaaattgcaaagccccaaagggtcagtaaaattcttgctgggcttcatcagacattacatttcataggggcacgggaggagtgtgctcttctgtctaatgaaatgtgggccttcagcctcacttccactgtgattcttgaaaaacatttatttcctcactaacggttcagtgttcagcaacctgggaggtttgccctagtactattctacaaggtcacaggtatactttgcaaggttctgcctctctttctctcggagagcttattctctcttgtggcctaaacctcacctctgtctgcacatgacactcaaatcagtttttttctgctttatgcttgtgtctccagagctgtttcaatgactgtattcggagtctctgcttgcagcgtgctctgcatgagaacaggcaccaagcctgcctataattggaagatctgcctgaatttccatagtgaaggtctacactgcctcccagcccattcattcccttcatcatttcattccagtagttttctaaagtgtggccactatgttgttgattatggcaacccagcatccacacaggacaacagggggcccagggccagtcctggctgctgcttatattttggccccagggatccatctgattttgtcattgaagtgctggcacatccatccccactgatgtttgtcaaatgatttcccagctcagattggaatctcaaaggtaattttcacaaaattggaaacagctcctctgatatgtccctgaaaacagtttttgttgcccatatggaggatgtgacaggacatcactaggaagatggacagactcagcctgcaacatcccctttccactgccaaagttgttagcaatccagacagactgtcaccttgaggctcaaagatcatcttacccccaaacactctgacgacctctctccctgtgtgccttgatgcaggtactgagtcttgcagcagagcagtgccaggccctgtgctgaggcctgcctgccagcaggattcgctccttccagtaacaggcactgattgagtcctccctgtatcacaggcatcggggaggagtggcaggtccagctgtctatgagccagacaccgtctctctgtcttcagcccagctggatatggagaacattcaacaaataattgcacatgtagttaataattacatttgtgataaataccagcaaggagaaggatgtgttgtcatagaatatgcaacaagatggtctctgggactggatgggggtggagaatcaagaagtgtatcttgatggatgggctcagaggggcttgcagaagagggacaccagtgttcagggtcatttggtggcaacgcaggattggctggagctgcggtgctcgtgttcaccttgccagctaccatttcacatcctgcagaggaggcaggaggcagccgtggagatggtttttcacaagacagcaaggagattaagatggtggagaggaggactagcttaatgctcccacttggacggacagagcagtgtgtggagactcacattgtgaacttctgctccaagaagtaccacaggaatctaccaagaaagtcaagagaatccacagaccctttgaaggaactggatccctgctacaggctccctgagatgccaaaaaactatgagtctgcttattttctcagtggggaggctggtggtctggggcaagttctcagccctggtcaccagctgcctggaagtagactcagtgctgttgccggggcacagtggaagtaatactggcctctaggactgccggctgcatgggagtggggtgaggcctatgattgccggttttcccccacttccctggcaacctgtgtaatgcagcagagacagccataatctccctggaaatataactccattggcctgggggccacacccccacagcagccacagcaagccctgccccaggaaagtctgagctcagacatgcctatccctgtccccacctggtagtctttctctaccctccctggtagctgaagaaaaaggccatagtctcttgggagctctgtggccctgcccaacacctgagaaacctgaatgcttaaccaggtgaccctaggccaagtttgcatcctccctcatgcacctcatgcacctcatgcactcttgaaagcaccacctcctggctggaggccaaccaacacaaaatcagcacaaagccagcacactaaacaaaaatacaactaaggaccctcacagagtccacgtcactcccctgttgcctccaccagagcaggtgttggtatccacagctgaagacctgaagacagatcacatcataggactctttgcagacactctccagtaccagcctgagcctggtagctctgctgagtggcaaaaaataatcacagcggtttggctctcaggaagtcccatccctacgggaaggaggagaaaaccacataaagggagcaccctgtgggaaaaaagaatctgaacagcagcccttgagtcccagatcttccctctgacatagtctacccaaatgagaaggaaccaggaaaacaattcgggtaatatgacaaaacaggcttctctaacacccccaaaaaatcacaccagtttaacagcaatggatataaaccaagatgaaatcactgaattggcagacaaagaatcagaaagttgattattaaactatcaaggagacaccagagaaaggtgaagtccaacttaaagaaatcaaaaacatgatataggacataaagggaaaaatcttcagtgaaatagatagcataaataaaaaacaatcacaacttctggaaatcaaggacacacttatagaaatgcaaaatccactggaaagtctcagcaatagaactgaacaagcagaagaaagaacttcagagctcgaagacgaggttttcgaattaaccccatccaccaaagacaaagaataaagaattttaaaaaatgaacaaagctgccaggaagtttgggactatgttaagtgtccaaacctaagaataattggtgtacccgaggaagaagagaaatctaaaagtctgtaaaatatatttgagggaataattgagaaaaactttcatggccttgctagagatctagacatccaaatacaagaagctcaaagaacacctgggcaattcatcacaaaaatatcatcacctagacgcatagtcatcaggttatcaaaagtcaagataaaggaaagaatctcaagagctgtgaggcaaaagcattaggtaacctataaaggaaaacctgtcagattaacagcagatttctcagcaaaaaccctgcaagctagaagggataggagtcctatttttagcctccttgaacaaaacaattatcagccaagaattttgtatccggcgaaactaagcttcagaaatgaagaaaagataaagtctttttcagacgaacaaatgctgagagaatctaccactaccaagctggcactacaagaactgctaaaaggagctctaaatcttgaaacacatcctcaaaatacaccaaaatagaacccccttaaagcataaatttcacaggacctgtatatcaatagcacaatgaaaaaaacaacaaagtattcaagtaacaaatagcatgatgaatagaatactaccttacttctcaatactaacgttgaatgtaaatggcctaaatgctccacttaaaagatacagaatggggccgggtgcggtggctcatgcctgtaatcccagcactttaggaggccgaggcgggcggatcatgaggtcaggagatcgagaccatcctggctaacacggtgaaaccccatctctactaaaaatacaaaaaaatagaaaaaaattagccgggcgtgttgttgggcgccctcagcctgtgagaggctgaggcaggagaacggtgtgaacccaggaggcggaggttgcactgagccgagatcatgccactgcactccagcttgggcgacagagcgagactctgtctcaaaaaaaaaaaaaaaagatacagaatgggcccagtgcagtggctcatgcctgtaatcccagcactttgggaggccaagacaggtgtatcacctgaggtcaggagttcgagaacagcctggccaacatggtgaaaacccaaatacaaaaaaattagctggtcatgtgggtgcatgcctgtaatctcagctactcaggagactgaggtgggagaattactggaacccaggatggagattacagtgagctgagatcatgccactgcaccccagcctgggtgacagagtgagacaccatctcaaaacaaacaaacaaacaaaaaggaatggcagaatggatacaaatttaccaaccaagtttctgctgtcttcaggagactcagctaacacataagcactcacataaacttaaggtaaaggggtggaaaaagatattccgtgcaaatagagaccaaaagtgagtaggagtaactatttttatatcagacaaaacaaacattaaagcaacagcagttaaaaaagacagaaggcagtttgtggggaagagggggcttagggagcacatagcactgggcagacctggtgggggcaggagggctggagagtgaggcttggaagtttcctaattccatgggccagggtcctgccagtgtttatctctacctttcaaaatctgtactatcattggagtcaaatgtacatttgcacacaaaaactaaacaaagaaatgaaaacaaaagtctgccccatgtcaaaccaacatctgggatgcctgctcaaagccagctcttgtttctgtttcttcttctgttcctctggaggatcttctatccctcgtttcttgatttagatactttctattattccttgcctcttctctctttccactccctctcaatttttcttagttatggtctgatttttacttcttttgcctttaaaactttttatgagttgtgtgagcatatttttctggttgcaccaatttgacagtctctcttgtctcccttttatctgagatgaggaaatatttttccctgtgcttcccttctgctagtttccggagctgtacctgactttcacatttatgacgttttaactcttacactcctattccttaatcccaagtctcctgggcttgctctagatgttgactgaaaactaagaagcagccttcacaatattaggaggattgtcactgcaaacaggagtgtagtgcacttggctgcagatagaaggacctgggattcccagactgatacatctaagaagcacatactaaaattcaaagtcaagtcaaatgaagtctcaaacacttttgtagcctatctaaaggtataaagcagggattcgcaaatattttctgtacagaatcaaatagcagatatttaggctttggggccatagggtgtctgtcacagccactaccctctgctgttgcagagtggaagcagccatagaaactgcaggataaaataagtgtcatgagttccaacaaaactgatttacaaaaagaggccactgccaaaccctggtccaatgcagaggatcaaaaacccctggagggcttgctgaaggcagattgctgggtgccatccacagttcctgattcagcaggtctggggtggcctaaggatgtgtatttctaacaagtttccaggaggtgtccatgctgctagcccatggcatgtgcttgttgcttggcactaaagcatgactctcttctacatatttgtgagtttcctagaattcccaacattttccctttgttttaaacttgtcctctgacttatcaccaagattttccaccatcgtgatgcttttgctttcacaagtctgctttcttcttaaacgtttctccctagcaacatttgcacctgcactcccctgaccttgcactgtggtagaccagttgctctctaagtctgctgctcagttgtcatctgagatagtcctttattgtcttgaggatggggctatgtctccttttgtctaggatttttattggttttactgcagaatatcatcaaggatttatctttttcactgaagatgcataaagggtaaacattctgaggcctaggatgactgaaaatgtgtttatttggcatcgacactcagtataatttttttttaccaggtgtagaattctaagttgaaaataatttcctctgtggactttgaagttactgcctcattgtattccagtgttactaatgagaaatctgatgcgagtttgactgtgatttctttacagatgccctgttttgttccttgtcttctaaaacatcacaatgatgcatttaggggtgggtgatttttttatatctcctgatcaaccgtcggtgactttttaagtcgagatgcacgcagcacctcctcatagctctggaaaatgttctcctaataggctattctttgatcatttcatttttatcagtttctgtattttctctttatgtaactctttggacttcctggatttaaatgctcttattaaactttttttctcatatctctcttcatgttttctctttttatgtacatgctgacagttgtccttcaagttttctttcagacatcgtatctttattgtaatgattatatttctaatatttaagaatattttattttctgatttcctctttttcattgacatatgcccttgtttaatgggtgcaatattgtccagcttctctttaagatacaagttagaatattttaaaagtgtactacatttgatgaatttttgaatttttgccatctttctcctgagtcaattattctgtttatgcatcttggcctattatgaatagaatgtttgtgtctcccccagatccacaggtttaagccataatgcccggtgtggctatatttggaggtgggggaggggggtctataaagaactaaagttaataagatcttaagggtggggctttgatccgaagggatttgtgttcttataagaagatacaccccagtgctctctcacagcatctctctgtctcttttcatgcaagccccaaggaaagaccatgtgaagacacatggagaaggtggctgtctgcaagccaggaaaagagccctcaccaggaacatgttgagagaagcagtcacacaaacgtagtcttttgacctctgtacagttgcataggagtgtgccttgggttaggaacattttcttacaaagagataaagagctttcacagcctgcgctgtccattaccctttatggggaacctctttctctgttctggactggaggcgtacttcttcgttctactaaagcatgtgcatcatatggcacctgaacgaccccactgctgggaacaggggcctttgtctatagcatgagtgtgtggaacatctccctgtgctggctgtggggtgagacccactggccatgagggatcaacagtcgaaactgaagctgctcttgctctgtgtcttctctatgtgcataaagcgttgttccatccagtgcctgcatgagtcgtgcctgaaaatcatgtggtgggttgacgtcttgggattactgctcctggaggcaggcattgttatgctttctgttctccactgtttagtgggactctgctgctggaggtggtcacaggtgtcacttgcttgacttggacttccagcctccagaaacttaatcttgaacttgcatcctccatcactgtgagaaaaaatttctgttgtttgaagcactcaatctatgacattttgtgatgtcaacctgagcagactaagacatgacccctcttttgtatgtaattaggtttatttaatattgaatggactttgttgatcctcaggtttattcccctacccctggatgacagactgcagactgctgcccccatacaaacatgagggtagctttatttgtaagagctgacatccacatagggagccctaacactccctctgcagtccagtgacaattatgttgactgtcagtgaatgtccaagtcagtgtgtgttcaaggggcagccagctgacatttgcctgcaatgtggatgtggcagcacatcctgccagtgtggcagaggggggaccctggcctcagcatgggaatgttccctggaaggctcagtcctttcatcattcaggttatcatggcgtcatcattcgtgtaatgtactgtgaggccatgtggccctcactcatatatacctgacatgtgacacaaattcactgtttgttttattatagaatttttttcacttaatacaaagtggaaaacttatagaaagcacaagcatatttctgtgtgttctcagtgtctttgggccatagtttctgcagaatatcttggaattggttcacttggagcataatgccagagcagcattttcctaacagatatctcagggttggtgaggcacctccccttgtcagagaaagagcactggacactgttagaggcagcaagacagatttcactcagactactgcagtagggcagagaggctccagtatgaatcagtttaattccaaataagacaaaggtgactggggttttcaaagggagatctgatagggcacacaacgagattatgggaagtaaaaaaagggggaccagaaaagagactgggggctataagtaggaagctacagagtggagttgcagaggattactgaaaatggtttggccttgtgggttgggacaatttacatctggcagttcaggagcattgcattttcttgagcagagactcacacaagagctgtgtcacttttaggcacatgactagtgcaggtagaagccaggctgaagtgtggccaaggatctcagcactgcatgtgggcaagtcctttgggtcattgggaagttcacagttcacaccccaacccaaataaaacatttggaaacaaaaacatttggaaatcacgcaaggtctatcttcccactttcccacctgtggacatataggaagttttgcatgaaagaaactttgttttctgtcatgcaacatttctcaaacattcttggtatcctacacgaaatctatttatatccaacataactaatgttctgaggaacccactttatgaaacaggattttgtactgctattagtggtgagtcacaataagaagggaaagatacccaagctcgcattgtgagaggtcatacagagatgggtccaaatggaatcaggagttgagaggcatagagatgtccctagaaactggaggagaccaccaagttgttctaaagccaggagaagaatctaacattggcctgaaagctaaagcctacctgtgggtacaaattggacaaaggatactttgctggacagtcagaaattcagctgtggagcaccaggctggcagtgagctctgccctcaggcacgccacataggcagcaccaggactgaggacatctgaggctgagaacggatgtaagaaccatcttgggtgttgtaagatgaattgcatcccccccaaattcagatgttgaagttctaaccacccctttggtgcctcaaaattcagaacgtgactggatttggagctagagtgtttaaaaaggcaattaaggttaaacgaggtcatatgcctgggtcctaattcaatatgacttccgtccttaagaggagattaggatgcagtcctgcacaaagggaagaacaggcagagacaaaggaagatagcagccatctacacatcaaagagacaggcctcaggagaaagcaactctgctgacacctcgatcttagacttctagcttctagaattgcgagaaaataaacttctgtcacttaaaccactctgtctgtggtattttgttatggcagccctaataaactaatacactaggggcacagagcaggtggggaagccagatgcaatcggtcaaaagaaaaaaaaactatttagtagccaaagaagacaggtgcaaataagcaagccacggttagagtctacaacagttagcttaactctgagcctaaccctagctggccaagagacacagaccatcatgacaagggactgggggactggactttccaggaggactggaacacaggacaaagcagtgggcaggacccagctcccctatcagacagggaagaatcagagacttgtagccacagggagctcttcaaaattcatgctggagctggaaccaatctcaagatatgaattgagttgagagatgtgagatatttaagatgctgatcataaagttatcacgtctgagcctggagcagagagtaccggtgacatgaagcaatcccaattgttttagatgatttaaatctatgacaattagccttatctctgtgttcatcacaacatttggacatgaccatggcgaagaaattactgccagttgtacttaatgggctcaaattcaagctgaagttttaaaacatgaaaataagaagattttattaatatataaattgtaatgttttcaagggagagttagcatcacagtccctttgcaaaatgttgtctagggaagctcaatttaagtgtttctcattgggccaatggagacttaacagaaaacacatcttgacaatagatttggtctgttgaaatgatgacgtttgttggccaaggactgaggattcatgctgtgcactgccaagtcctatgctcttcttcaactctgctactgcctgcttttcattgtcgtcattggttcttcttccagagtacaaagaagaaaagaacatagggcaaaaagtgctatttgtgactttttagcacacataaagtaattataagtaggcatgaaagcaaggcatcccagagtttggaaagtttaataaacacactttagttaaagtgtaggtaagtgggtaagtatgcaaagttagacttaaaaaaacagaccgtgcaaaaacaagacaaaattgcattttaattgatgatattgatctacctgaagaagtaatgtgtcacttagaagaaaagagtccagcgtggattacaagaagacataatcagagatgcaagttgaaggtcatttaagaaaacatgtcagtgaagttccttccaggcctgtgcttgggggccatacacattcactgagtgaacttacatataagacctctaactaattcccattgctgtgaatctatatgcaccacaaaactttcggattctcatttgacttcccttaagtcagaataaactttcagttttgtggtagataattttattataaaataaagaattattttgcttcatatattggtttcctgtctgcttgttattgtggattttcttcagtgatggccctcagcctctactgaggcacaaacaaaaccaagttttgctatggcaaaggaggtggcgactgtgaaatgctctagtgcatgcaactcaggactgctggggaggcaccggtttggagcaggcatgcaggcatccctctgctggtaccctctcacctgacctaggcctgcaatccagaacaacgcttttgggaagaaaaactgatgtctggaactgatagggaacctgaagaatttatgtggtttattattgtgtctgtgccttgaactctttttagcaaataaaatctaattgagtttaattgaattgaacatggatacattacatagataacattttctaaggctacagctgccatagatagtgatcgctttgatgtatccaggcaaagtaaataaaaagccttttggaaaggactcaccattctagacgccacaaagaacatgtgtaattcatgggaggaggtcaaaatatcaacattaacaggagattggaagaagtgtattccaaccctaaggatgattttgaggggttcaaggcttcagtgggagaagtaactgcagttgtggtgaaaatagcaagaaaactagaattagaagtggagaattgctgcatctcttgataaacttgaatggatgaggagtttcttcttatgagttaccaaagaaagtgattagttaagatggaatctactcatggtgaagataccatgaacaccattgaaatgactacaaaggatttaaaatattacataaatttagttagtaaagaagtggcagggtttgagaggattgacttcaattctgattgaagttctacagtggataaaatgctattaaaggaaacttgcttaaggaaagagcccagggagggataacttaagccagcatttgagttgaggagacagaattgggacagagttggctcaggggaaccaacgtagctagagttcatgggacagagtacgagggaagagacaacgagagagagagaggaagaagaagaggcagagcaaaaggaagaggaagagaagagaggaagagaggaaagaagagagagacattgaactccagatatctgcaaagatgtcacttgagtctccaggttagtattgataagtgcatgtgtatgaaaatatccaagaccaaagtacagtctaatgaagtaggcataataatttccagggatcacatggaactagggatattttgtttctatcagccagaaaggcaaactgttaaaatgcatgacacattgggtacagtaatcggaaatatattggctcagtaacagaaaaaaaaaatagcccttgattaaaggtttgatctatcccacgtaagaaagattaaaagcaaagctagaaaagatcagatttgtttctaaataacttatctgcgtcctaaaacaaaactaaaaaatttttttaaatacagtaatgtattaacacatactgaaactcaatacatacagagaaacgaagataagaataagaagtccaagtgcagcggctcatacctgtaatccaagcacttggggaggccaaggcaggggatcacttgaggccacgaatttgggaccagcgtgggcaacacagcagaaccctgtctttacaaaaaaaaaaataataatttttttcctttttggtagagacagggttttactgtgttttttcggggggaagaaaaactgatgtctggaactggcagggaacctgaagagtttatgtggtttaccattgtgtctgtgccttggactctttttagcaagtaaaatctaattgggtttaattgaatgtgttcccaaataaaaggcagagattttcagattgggcagagaaagtaaaaccaacatcaaaaaattaaccttcagtcccagcttactcgggaggctaaggtgggaggatcacttgagcccagaagttcaaggttacagtgagctataattgcaccactgcactgtagcttgggtgacagagcaagaccccatctctaaaaaaagaaaaaagaaaaagaaatcagctggacatggtggctcatgcctgtaatcccaaccctttgggaagccaaggcatgcggatcacctgaggtcgggagttcaagaccagcctgaccaacatggagaaaccccgtctgtactaaaaatacaaaactaggtgggtgtggtggcgcatgcctttaatcccagctacttgggaggctgaggcaggagaatcacttgaacctgggaggcaggcagatgttgcggtgagctgagattgcgccattgcactccagcctgggcaacaaaagcgaaactccatctcaaaaaaaaaaaaaaaaaaaaaaaaagaaagaaagaaaaagaaaaacaacagtgaaatagtggaaacaataagccagaagatagtggaaaaacatctttcaagtactgaaggaaaatctggcaacctagaattctgcacccaacaaaaatagaaaaaccagaaattgactttctccataaaagcagataggaatgtgcatctacctaaatgaatgaagaacactggaaatggaaatgtgtgtgttaatatttgggtgaatacaatgacatttttatattttgaaatcactctgaaaatagatgattaaagcaaagtaaccatgtattttaattttaaaacaaattcagaagtaaaatgtgacaacaatcatgcaataatgggagaggaaaatgtaagtatacagttgtaaagctcttatacgagatttgaagtggtaatattatttgaaatcagactttcataagtcaagatgcacattataaactaagagcaaatagccatgagtgaaaaaataactaagaagataaattaaaagtatgaaaggtgctcagttgacccaagtgaaggcagaaaaatataagaaaggagaacaaagaacagatgggaaactatattaatatcaaggtatatttcaggacaagggatggtgccaagaaaaaagagggtctttcataatgattacaggagcaattcatcaaaacaatataataaccctaaatgttatgctcctaataacataacttcaaaatacatgaaggaaaaaaatctgagaattacaagaagaaacaaattcacatttatagttggagatctcaacatcccactgacaataatcagtgagaagtagatagaaaatcagtaaaaatatagccaacttaagcaacattaccataatcctgacctaatagacatttatagaatactccatcatacatattcctttcaagtgaacatgcactatttaccaaaatagactatatcataaaccatagaaaaattctcaataaaaaaggactgaaatcatccacaattcttctgacaacaattatattaaattagaaatgagtaacatgaaaatctgaaaaatcttcaaatatttgcaaataataaacatgacagcagaaatcaatgaaatagaataacaatcagaaataaaactaaaatccactttttaaaaagcagtaataaaattagttcattattatcaggaattaaaaagggacatcactacaaatcctacaactattaaaaagatgatttttaaagtattataaacacctcattacggtaagtgtggtaacttagataaagtggacatatttcttggaatatccaaattatcgaagctctgagtagctctgtatctatttttaaaattgcattcatagttaaaatattcacacaataaaaatttcagacgtacctggctccactgattatttctacattcaaggaagaaacaataacaattctcaaagtttagataaagaaaaagggatcaaatcattagtctgggttcctacctcaagaaactgaaaaaaggagagcaaaatacattcaaggtaagcaaaagaaaggaaataataaagataaaagcaggaatttataacactaaaaatataaaaacaatggaagaaaaccaataaatcaaaagcagcttttttgaaaagaaaataaaaaatgataaacatctagcaagttgacaaagatataaaagagagagacgtgtcaccagtatgaggaaggaaacaggagttattactgcagatcatgtagccattaaaagaataagggaatattatgaacaacttcacactcataaattcaacaactgagaagaaatggatcaatttctcaaaagtcacaagctatgaaactcaatcaagaagaaatagaaaatctgattagtcttacaatcattaaattaattgaatacataataaaaatctcccgcaatgagatgttcaggccccgatggttttactagagaattccaccaaacatttaggagagaattgacacaaattttatgcaatcacttccagaaaatagaagagaaggaaacactaactcatttatgaagttagtattaccctaatacaaaattaaacaaagagtacaaaaaacccccaaactatggaccaatatctcccataaacttggatgcaaaaatcctcaaaagtattagcaaatcaaatccaaatgcatagaaagaattacacgtttgaccaagtgggatatattccagagatatatatctggttcaatatctgaaaatcaattaatataataattatatcaataggctaaagaaaaatcatataatcatatagatatcctcagaaaaatatgacacaatccaacactcattcaaaagacacgcctatcacttgggaaattgcagttctgtgccaggaaccagggacaaaaaccaaatatatttcatcttgtgtatccataggttctgcatctgtggatccaacctatcatgaatcaaaaatattttaaaaaaatggagttcgtattgaacatatacagacttttatcattattgcaaataatactgtataagtataataattatttacatagtgtttacatggtactaggcaatataactaataatagagatgatttaaagtatatgggaggaggcgcataagttatatgctaatactatgccattttatatcagagacttgaacacctggggattctgattgtcagtgggaggttctggaactctgccccattgatatcgagggataactgtacatgaagttgacgcttgaacaatgtgagcatcaggagctcccctccccgacatatatgtggatttttgtgcagtcaaaaatccacatatgacttttgactccccaaagcttaactactaataccctgttgagtggaagacctactgatcacacaaacaggtgagtgaaaaaatctttgtatgttatatgtattatgtactgtattcttacaataaaataagctagagaaaagaaaatgttattaggaaaatcgtaaggaagataaaatatatttactattcattaagtggaagtgagtcatcataaaggccttcattctcattgtctccatgttgagtgagctgaggaggaagaggaagggaagggtttggtcttgctgtctcggggtggcagaagaaaatccacatataaatagatttgcacagttcaaacccatgttgttcaagggtcaattgtatgcatattttattagatacacaataagggatattatgtagctacaataatcaagacaatgtttattagcaaataatagatacacagatagatggaacaggataaagaacccaaaaataaacccacacaaataagcccaactgactaataaaggaattcatttcaacagagatgataaagcaatttaatggaggaaggatcgtctttttaacaagtgacgctggaacaatttggcattcataagccaaaaaacgaacattgtcctaaacatcacagcctacacaaaagactaactcaaagtgcatcacacacacaaatgcaaaacataaattagaaaacctttttaaaaagacaaatgaaaatcttccacgatatatggctaggcaaaaacttcttagacttggcacagaaatcatgatctagaaaggggaagaaaaaattgataataggacttcaccaaaacttttgctctgtgaaagcctatgtgaaaagaataaaaacctgggagaaaatatttataaaccacgtatctaaacaatgacttgtatctataatgtatatagaacacttaacactcaacagttaaaaatcaatccaatgagaaattagcaaaatatatttcactaagtaggacagacagatgatgaacatatgaaaagacatgcaatatcattagccgttagagaaatgcacattaaaatcccagtgaaatatcactatacacctgtcaaaatggctaaaacaaacaggcaaactaacagtgatgacaccaaatcctggcagaaatgccacataactggataactcatagatttttggtggaaatataaaatgggacaatagtatgtacagcctctctgggaaaggttcagcagaaacacttcttacaaaacacttacagtatacttattatacaacccaggaattacactcttgggcatttatcccagagaaatgaaaacttatgttcacaaaaaaccagtatgtgaatattcacagcagttttgtttataataattgaaaactggaaacagctcaaatgtccctcagtgggcaaatggtacaactgtggtacatgcatatggaacactcagaaataaaaaggaacaaactattaatatgcttaacaactttggtgaactccaggaatttgtgcccaccaaaaaaaagaaaaataaagccaatcgtaagaagttacatgtgatatgattccattaatatagcactctcgaaatgacaaaattatagagttggaagacagattaatgattgccaagggctcaagatacagggagaggctgtgactatgaaggttagtaaagaattgttgatgggtctgtttgtatcttgactgtggcggtggtcacacaaatctataagtaaggtaaaatttcatagaaataaatatccacacacagacaaatgagtgcatgtaaagcaggtgaaatttgaatagaggcaatggattgcatcaatgccagtgtcccacttttgatactgtactcttgtcatgcaatatgttaccactgagtgaaattgggggaagagtttatgggatgtgattatttcttagaactgcatgtgaatctataattatcgtaaaataaagagtaaaaaatgtataaatacctcatatactggtgcttagtctaccactaaaatttggagatgactcagaagttgtctccagaacctgaactgagcagcctagctggggtctcaggtgaaggagccctgctcaaggggctggattacccccataaactcaggcttaaggtacagcaaagccagccttggtggagaagtgtggggttgaaatattttgataattgatattttaatagaagcatttcagtagtcattatgaggggggaaagaggaaaatcagtaaataaatgtagaaggaatgaacaaaatagaaaaatcaccatagtgtaaactagtaaaataagggattcagataaggatcatcaagagatgctgaaaagcagtaaaggcagggtaataaggaacacgatattcctgcagtctcataacatcaccccatggagtgcttgcggactggaaagggtaaacataccttagataacggagcaccgttacacatttagctatgcaatacacttaacatcactaacagaaacttcctaatattatgtgcctcttggtgcaaggtggtatgaaatacacagaagccgtattcttgccaaaaatatttagtacaaatctaaacaagcttttaaatctagtttctcagttgtatgaaatatggaaaatagaagattcaaccatgaatccagaatacaaaatattccacaagctcagttccctcaataaatcaataccacgacaaaagaaaaaaggagagggctttctttattgaagagacgcaataacaaaatgtaatatgcgaatgtagactgtattcttgttttaataaaattataaaagtcatttttgaagcacttggagaaatttgaatatggactgtgtacgagatgatagtggggattagtttaattttcttcgctttgattatgggggtgtcattttatagcaggatatttccattttaaggagatatataatggacattttttagtggtgaaatgtcatattgacagtatcttccttctgaaagaaaaagtatggaagagacaaaaatagatcagaaagagcttttccccagtgtctcagagacgttttctacctggactggatgttgtgtactggatgcgctccgaatgtgacttcaaagggaacgtagttgggtgcttactaagtgccagtcttcttacacagcaggcttttagggattatctcgtttagtccgcacagcaatcctctcagttgaaatgcaatagattgtctattaagattatctgaaataagaatcttctcgggcagatgaattggttctgagagtcaggagagtgcatcaggaagtgagatcatggaaaagtggctttcttaagaagggagtgaagcttcaaacatggattcacttttggacatgtagcgaatcgaagatttggattccttaaccgagaatgcttttaagaaattgaacttcctggccgggcgccgtggctcacgcctgtaatcccagcactttgggaggccgaggcgggcagatcacgaggtcaggagatcgagaccatcctggcgaacacggtgaaaccccgtctctactgaaaaatacaacaaattagccgggcgtggtggcaggcgcctgtagtcccagctacttgggaggctgaggcaggagaatggcgtgaacccgggaggcggagcttgcagtgagccgagatggcgccactgcactccggcctgggtgaaagagcgggactccgtctcaaaaaaaaaaaaaaaaaaaaaaaaaaaagaaagaaaagaaattgaactttcttcccgaggaccaaatagattcattttgccttaacgagatgttaatactttgtgactcaagtgagtttataagtattatatgtatttctacacaaaatgcaaatttgaataataaaaatttaggaaatttttcctgtattcactttacatcccttaacttcacattcagttttgaatgagtaacaataatgtgtgcagagcctaccaaagatgcagaaagggaaagctcagaacaagcagaaataaaagctgtaacttctgaaaaaactgaattaataggctgggcgcggtggctcacgcctgtaatcccagcactttgggaggctgaggcgggcagatcacaaggtcaggagatcgagaccatcctggctaacacggtgaaaccccgtttctactaaaagtacaaaaaattagccaggcgtggtggcgggcgcctgtagtcccagctactcgggaggctaaggctggagaatggcatgaacccaggaggtggagcttgcagtgagccgagatcgggccgttgcactccagcctgggggacagagggagactctgcctcaaacaaacaaacaaataaaaacaacaacaaaaaaactgaattaatagcaagtgtatttcctgatgctgttgtagacccaaagaatactaacgaactgctccctaatagttaggcagaacttttaggcttacatagcatcaagtagtcttttctaggtatctaaacgctacaacccctaaagacatgaatggaatggagaagaacccagtagctccagacattggacacagtatacattcttctttgaatctgtgtgatattttgaactctgtgttgagctcttcacatcttgaattaaatgaggaaattaattgtgttgatatacctaatgctaaatgacgagttaatgggtgcagcacaccagcatggcacatgtatacatatgtaactaacctgcacattgtgcacatgtaccctaaaatttaaagtataataaaaaaagaaagaaaaaaatgaaagatttccaaaggattatgtgaaattttattttattgtttaaattattttattttattttattgtttaaattattttattttattgtttaaattattttattttattttattgtttaaattattttattttattttattttattttatttattttatttattttatgttatttgagactgagtctctgttgcccaggctggagtgcagtagcacgatcacacctcactgcaacctctgccttctgggttcaagcgattctccttcctcagcctcccaagtagctgggactacaggcatgcaccaccaagcccggctaatttttatatttttagtagagacagggtttcaccatgttgggcaggctggtctcgaactcctgacctcaggtgattcgtatgcctcggcctcccaaagtgctgggattacaggtatgagccactgcgccgggccagattatgtgaaattttagataaacacagaagaatttatgaatgacgatgaacaggaaatggagaaaattctaatatcatgcggtactttgtcagccagagtcagtgacaattattaggctgatatgttgactgccatgccagggatgatcaaatctcttaccatccactgtctggaggtgccaacacctgctgaactggctttccagatcaatgaattacagtcagacactgtgtaataatgtttcagtcagtgacaaaccgcgtatacgacagtgatcccatggattataacagagctgaaaaattcctatagcctcttgaagttgtagccatcgtaacatagtgcagtgttttcctcccatgtttgcggtgatgctgtgaaaataaacctattgcactaccagtcttataaaacggtagcacgtagaattatgtacagtattaatgcttgataatggcaataactatgttgctggtttatgtatttactataccataggttttattgttattttagaatgtatgtttctacttataaaaaaggttaactgtaaaacagcctcaggcaggttgtcaggagttattccagaagaaggcactgttatcttaggaagtgacagctccatgcgtgttactgcccctgaagaccttccagtgggacaagttgtggaggtggaagacagtgacactgatgctcctgaccctgggtaggcctcggctaatgtgtgggctcatgttttaatttttaacaaaaaagtttaaaaagtcgaaagagtaaaaattaaattaaaaaagcttataggataagaatataaagaaagaattttttttatagctggacaatctgtgttttaaactaagtattattacacagtagtcaaaaagtaaaaaacaaaaacaaaaaaatactaaaacgctcatagggtaaaaaagttacaataagccaaggttaatttattactgaggaaaaatatattttcttataaatttagtgttgcctaagtgcacagtatttataaagtctacggtagtgtaccgtaatgtcctagccttcacattcactcaccactcactcactgactcacccaacgccacctccagtcctgcaagctccattagtggtacctgccctaaacaggtgtaccatgtgtgtcttttatactgtattttttactgcactctttgtatgtttagacatgtttagatacaaacatacttaccgttgtgttacagttgcctacagtattcagtacagttacatgctgtgcaggtttgtagcccaggagcagtaggctgtaccacagagcccaggcgtgtagtaggttatgccatctaggtttgtgtaagtgtacttagtgatgttcgcacagtgatgaaattacctaacaatgcatttttcagaacatattcctatcattaagaaacacatgatatttggccatgttggaatggattttagggtctctaacagttgaggatagtctagttcatgtagatttgaacctgacaaaagtgacttatgagaaattgcaagaattcttggcaggtttctttttatgaagaactccctttgtgctcattttgtcacctttacttttgtcacctttactttctataacaaaataaaccatgttacatgaaataattctattgaattttgattttgagagagaactttcaccagttaacacgttgctgattttgttttcctctaagtttttagattaatatcagattaggcaaattataccattagtgatgaaacttaatgtgaatgattgtttctgaggggaaaaacctcgaaaccgtgagatttttactctctcagttaaataatgcaatgctgattgattcagttttaaaaacagtttttattttttaaagcagcagccgaattctcttaagtggagggatcgcataggtgtcctggagctccaccatggtgagtggagtcacactttacaattttatttatccagctttatttgttgacttacatttaataagaatgattttgtcacaattctaaaaggcgaaatgatttctagaaaaaataatataaatatatttactaatatacccgtcctttgccaatctcttgtcctgcacatgtgtttagaagtaacaaaaacaagctgtgtcctatggcaagcttacgggaggccctcccctggttgggcatgttggacttgatcatactgaacaaaattcatctcagagaacaagaaattactgcagactttagcagcacccgaagtgttactctgtctaattggatcatcggaatagtcaagtttttaaaagtgtcactcacgccgggcgcggtggctcacgcctgtaatcccagcactttgggaggctgaggcgggcggatcacgaggtcaggagatcgagaccatcctggctaacacggtgaaaccccgtctctactaaaaatacaaaaaagtagctgggcatggtggcgggcgcctgtagtcccagctactcgggaggctgaggcaggagaatggtgtgaacgcgggaggcggagcttgcagtgagccgagatcgcaccacaccactccagcctgagcgatagagtgagactccgcctcaaaaaaaaaaaaaaaagtgtcactcacagaaatagctaacagaagaaattgccttacaggaaaaatcacgacttaagaaggaagtcacttatctttgtaatagaatgtgtcatcagactgaagaagcagcagctctccaagttactcctcgccattaaccaaaatttggaggtgtacactttcaaggaccacagttatttcttagaacatacagtgcaattttaaaactgtgttcttgaaaggaatcgtttacaaaaagttatagcacaggagtttttcatgaaaatgcaaatgtcacttctgctgaatggaaggctaaagagaaaaggcaaagaaagagactcaagacatacgaagtgggcccggtcgtggtggctcatgcctgtaatcccagcactttgggaggccgaagcaggcggatcacctgaggtcaggagtttgcgattagcctggccaacatagtgaaaccctgtctccactaaaaatacaaaaattagtggggcgtggtggtgggcacctgtagtcccagctacttaggaggctgaggcaggagaatcgcctgaacctagggacagaggttgcagtgagccaagattgcgccactgccctctagccttggcaacagagcaagactctgtcttaaaaaaaaaaaaaaaaagtggaccatttctaggcattggatggttgcagaggagatgccctcatgcacctacagaagtggagggcatgcccaccaggtcagtccccataagtagacgtgcaaagctcatcacgcctccctgttgtcaccaaatgtctcagacctccatgggctgcatgtggacaaagctagagaatattttatgacaatgctacagcaaaaacctgaagatttaagcaaaatgcctctctgtgattatgggggttgaaaagcatagccagggagcagccactgtcatcagaccagctgctgccataaaatgtctcacagccacaacttctggatctctgaagttaaaccagactttagctctgaagtcgggctaaagtaaaagacacttccttaacttagaactgtgaagaatttaatagagaaacaaggctgaacacatctgaattttgaagagctatttatgacttcatgtcgtatatgacaaattttattatcgttctctttaaaatcgagcaattgattctcatcatccaaagggtgaacctgtttttaataaatgaattaactatgagactgctcattaaaatgtaatattgcaactatctatggaagaatagattatacaattttcagccagcataagaaaaacaaaaagattttatttgaactattaaaaaaagtaattttcctgtcaactctgtacttttttatatacatttttataactttgctttaaaaatttcttgtgaaacgatttgcaaattacatatagtataatagtaaaataaaatactttggccaaaaaaaggatatttactaatatgcaatgtagccacactttagaagcttatacagactttataattgtccttgaaggccagaagtttgttttgtcagtcactctgcttccttgggttccactggcttggaggggctctcaccagcatcttccattgtccctgaaagggttgtagaggtgtgcattagtttcctggggctgtcataacaaaatactgtatagtgagtgtggcttgaccaacagaaatgtatggtctcacagttctggaagcaggaagtccaaaatcaaggtggtggcagggttggttcttctgagggctgtgagggaaagatctgttcctggcctctctccttggcttgtagatggctgagctatagttttgttattttttccctccaaatcccatgttgaaatgtgatccccaatgttggaggtggggcctggagggaggtgtttgggtcatgggggcagatccctcatggaatggcttggtgccctccctgtggtgatgagtgagttctttctctgtgagttcatgcaggagctggttgtttaaaggagcctggtgcctcctccctctctctcttactctttcactcaccatgtgacatgcctgctcccccttcaccttccaccatgagtaaaagcttcctgagggctcaccagaggcagatgccagcactatgtttcttgtacagtgtgcagaacaatgagccaaaataaacctcttttatttgtaaattacctagtctcaggtattcctttatagcaacacaaaacagactagtacagctgccttctccctctgtctcttcagatcatcttccctgtatgtatgtgcatctctgtgtccaaatttcccctttttataaggacaccaggtcatattggattaaggcccaccctaatgaccttattaatttccctttttataaggacaccagtcattgggttagggtccatcctaatgacctcacttgaaatcctgcctccagatgagatcatgctctgaggtattagggattaggatttaacatgaaagtgagggggatgcaattcagcccatcacagggtggattccccttctggggctgtgttactcaaaccatcccaggaagggtaacagggccagaggagctgaagaattgtgagcccttgtttaccaggcttggggggttctgtcttgcactactaccctgaaaaccctactggttgccaattgaatttatcagggaactccagtgcccagtgacaaaggctggaaatcttttctcctaaagatctttaagggtgcacctgccctcacagtccctctggctctgagcttgtggctctatctgttccctatgcccacatgaatgagttctgcctcaatccctgctccccactgtggggaaccaagtaccaacctcaacttgctgggcagatgctacgtgacagtctaagtgctaagctctttacagacatggtctcattttatcttcctcataagccaaagaggtaaagaatgacattactgttttacagatgagaaggccacattgtgaagaaattaagtgatttgcccgaggtttgtgttgatcatttcattaaatgaagtatcatatctatcatactttttcatttattagaaacaaaataccactcacggtaagaacaaagatgtggaggagcagtagaagaacagagaagtaggagtggaatttcatgagtccccaaaccgaagaccaatacctatgattagaaatacaggggactccatgttcatagtggcgttattcacaatagccaaaaagtgaagtcacccaggtgtccttgtgtggatgaatggataagcaaaatgtggtccatgtgtataatgaaacattacccaacctcggaaaggaaggacatcttctatacgccagaacatggatgaacctcgaggacattatgctgagtgaaataagccaggcacaaaagaacagacactgtgtgattccacttacatgaggtgtctggagtgctcagtctcatggagacagaaaatagaatggtggttgccaggggataaggagttggggatagcatgtttgcatttaataggtacaaaatttcattttaagaagatgaaagttttatagatggttggtggtgatagttgcacaaaaaggtgaatgcatttaatgccactggactatatacttagaaatgactaagatgatgagtgtttatgtgtattcacaacttaaaaataatttttaaaaaagaaaggaaaggcactgaccccaacccacacactcaacagtttttgaatccagattttctggcaatgatataaaatgtcttttgatccaatcactcaggaaggtcaagagaaaaccctgcatttttattgggaagaatagcctcgaagcaggagcatcgtttagaacctgtcttgtgcatcttcagtaaacatttgagtaataaatcactgttgcacttgaaggaaggtctccaggttctggtggtaggtgtggggttggcaagagtgcagctttaaggtgtgagctccgggatttctcactgaggataagttcatctttctaccagttctgcacagttgagtctaagcacaggtggtggtggggaggtaaacatggagatgaccaaggaaacacactctgacccatccctgattgcaaaatgaaagggtgttggatccagaatgtggttggtacttgataggtgcactgtccctgacaaaaacggggcagaggggtgacctacacactcctatttctcatctccagtttgttccttatcaactaccactttctcttcctgcctctcctgagtcttgaagtttgtaaagtctggtctggcttactcctcataggtatccagcatttagttttgaaacatatcaacacttgtacaaatggcagttagggtgactgttatgaaaaggaaatctaatacactattcctccacttgaaatcctccatgtctccccattccctgaggcacatgattgaagcccgaagaatgcatgccccacctgctccctgcccattggtccagctgccacccagacaaggtctggcaccagatccatagtcagcagtgctggccctgcagcctctgctaacggggctcaccagcctgcagcctcggctcctccatactcacctgcccaccactactagctcagcctacaaccttagccaactccttagcctccaggaagacctccaggtggttcctcaacttaggtgtctcttctaaccttaatcctggaagttgacttgctggttgcattatgattcctaagccccagctgtggagggagagtccctggaagatgggacaatgtctttgcccctgaacttccatccctggcatagtgccagctttttcatggagggtattcagtaagcactgcatgtgaaatgcattgtgccaagttattttgcctcgtttaactcttgaaaagcaggcttctgtgcagaccaggctcaaatccatgcttccaggtgccctgtgcggtgccaccacagtgtagcacacagacctgcacgtgcctacatggcattgattccaggccttggtttcctctttgggaagataaagtaactgtactaaatgcagagagaaattagttaactttatcacttgcttttagaatgattcttgaaatatgaataaaaaatataaatttctggcttattttggcttttcttttcctagagtaactgaatttttaaaaatcaagcaatgcaggaaggaataaaaacaaattcaggtttacatatatgagactggcagcacaatacaactaacctctgctagttggtgactaacagttggaaatccatcctggaagttcccaagcacatcagtgttgcagaggaccttgaaagcacagcaaatgggtgagcacacattattaaacttttattaggttgtcagccttgtgtatctctttcaaaaacgtgtagctcataaaaacattcttcacttatcttcagctgatttgatgcaattttcttcaatggtgcttagttatatttaatccctgtgccatacttatgtccaaaaaaatgggaaataatgcaaagcaggccatattctaaaatgaaaagcattaaattaaggttctaggttccctcaaaaagagcaaagcagagtggacctcaccttatatagcatctatctctaaactttgcattttattttgaaactctgcaaagcaataaaaaactcattaacttttatagccagtcagaaaggtagtaatagcatctgtagcaatggagatgtaattaggcttttatttaaatgtggcagggagtttgttctcattatacgaaataaatgaacaaccacaaatcaccagtggattcatgctccctatggtgctggtgcaagtggtccaggaacttgcccagtgctgcttccttatgtggcaacagagcctgtgagccccagagccagggctggatggaaaccagctttctgaaggttgaatagtcacagcaattatattaacgattataatcatgacagaaaagattctccgtccacattgttgtgttaaaacagaaaaagaaaaaaaaagtgttgcagatcatcaatgcaattcttaacttggtcatagaaaaacaccgaatttgatcatcctcttgtctctgctgtagctaagctcctttcctggcctccaattcctgtttccttcccaatacagcaacttccttctatctgtattatctccttgcccatttagatagcctcagaaaaacatggggaagaaccaatttgaaaggtctcagtgggtttcatcaggttcctaacagataataaatgctgagctaaggaccctaggttcttccaaaaaatgatgatattaaagctctacatcctctttttgaaagtatgtaaaactactttagtggttttgattcattttaatcttatgtcagctacattattatgtaagggaaattcaaagatgaggatagaaatttactcagaaaaagtataaattgatttctgtttaaagatgattttccggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgaggtggcaggcgcctgtagtcccagctacttgggaggctgaggcaggagaatggcgtgaaccccagggggcggagactgcagtgagccgagattgcgccactgcactccagcctgggcgacagcgagactctgtctcaaaaaaaaaaaaaaaaaaaaaaaaaaagatgattttccttaatctcatctctcaaaacccacaaatatatatgtattactaggtatgtgtgtgtatatatatatataaaaaatgtatatatatgcacacatgtgcatatatattttttgttgttgatttgtttgtgtatatgtatatgaatgtatacacatatgtgtatatacacacatatttatacactcatgtatatgcacacaaatcaacaataaaaaatagagggcaaaaaatccaatttatatataacaagaaaatggctacattctcaaaacatcttgactggagctcgagagccaataaaaagttgatctctgccacctgagaccttgggccaggatacacgtgctcttaaaagggcaggttccgtgttcacttgtatgttccggccccagctgctttccctgatggaagagggccagaggcacacagcgggaaagtggagaagctggaagggcttaagagtctaagtctggggaaggtgaaggagtgtccccagggcgaagaaagagcaggtttgttggagggcactcaagaacacacccacgtgaaagccgtagataggctttccctatcccgcatcccgccacactcccatcccacccctcggcagtactagctcagccaatggggctactgactgtcccttctccaagatgagtcatattgagaagaacggcctgggcccatggagaacaactgccatcaaacaatcaattggcagcatccatcaaatacctgatggagggaaaaaaggaaagacagaggcacatcggggcagatatcacgaaagacagttttcaaggacacagagagggattctcaccaacagtgcttcattctgcacaaagattctatgcagcaggcagcattttctgcacctgaaacgagaactgtcacggaagagtcaggatattcaagtaagaggccgtgtgacagtgggagaggatgtgaacagagctgtcagagtccattaggacatggaaaggaggaagaacactgcagaaataaaaaatccatatgaagcgacaacaaaggaaaaacaagacagatgatatcatgaggtcttgacaaatagacctgggaaaatctcataaactacgtattaaagagaaccagggaacttaaaaatgcttttagcaaaacaatggccaggagagggcaagatagacaaggacagctcggctctcagcaggcgcttctaaccctctcactgtccccgccgccagccctgggggaagaacactgtgtttttgtttttgtttttactacagattcttaaatattttaaattttgaaccatagatatatgtttccattttagcattaatcaataaaatggctgttggaaactcagtgaagaacaatacaagaaatgtgataaaccccacaatgggtatacgaccatctttgatcaattttacaactgctactgctcacccctcaatgcccatcagtctctcacaggaatgcaccaagagaagagaatctccagcaggaggcccagaggtggaagaggcagggatgcgaagaagcagaggaggctggaaggaaccggcgagaagtggggacagcgggagtgtaagtgagagccagtgaggccgctcacgcagggcacccggccaggtgaaaacttttagaatttgcttcaaaagtcagtgaagtgctctaagcagcacagtgtcaaaatcagatttaaagttgtcaaagggcatttttaatgcaaaaagcaacagactgggcaaaagtgtttttaatatgtgtaaccaaaaaaagagagttaaaaactagtattttttttcaaaatgttcccagaaataacataaataaaattagttagaaaacaaagcagacaattaaaagaaaaagagatacaattagtcgataaatctatgaaaaaatggtcactgtatcgtaaggcctgaaatttcatttcccaccttaacgccttcgaccctcacaaggccccaagggtctaatcctaagtccttatgctcacaccagacgtgtacccccgccagtgggaaaggctccttgcctggccagttccccattagctggactagcttcacttaacctgatcctcactctaatgggcttcgcttccctgccagctcatgaaattattcaaaaaagctagtcatatcctcacatggggcctggaggcacctcagcatcttgttagttcaaagcctgcctccttttcactagagtccctgcaggctctctgtgttcccatgtgcaagtcccttatggccctgtgtaaaatgcaatgtcctcctccccgaggccttgagcatatgtaagcaacaaaccgctatgagcttatctgtccagtcccgcagggtggatgcaagtggtcagaacagtcacctcatttgtaatcagagaaacattaactgaagcagcaatgatacggaatatttttacccaatggattcataaaattatgaaccagtattaactacctgtgttggcagtggtttgcatgggaatatatattggtggtttttcaggggatatctattaaaatatacaaatcctgtgacctctgatttaccttctagaaacatttacttagatgcactgttggtaacagagaaaaaattggatagagcttaaatagctactaaaagacaatggttaaatgagttttgatatgacaactgataggcaattttgtggactggctcatttccaatcttcttcccttgtgtctccctggactgcagagaccagaaagccagaaactacatttgctaagctccctggattacaggcatgacttagctctgccaatgagatgtacttatgtgtgatttgactttggatctgttttaggtgagatagaaatagcataaagcagtgttttaaaaaatactttattgtttagaatggtgttaaatttacagaaaaattgcgaagctacagagatcttgcatatgccagcataaccttttccccctattattaacatcttacattcttaaagttaatggatcaatagtgatatatgattgttattaagtaaataccacagtttattcagatttccatttatttatttagagacaaagtttcgctcttgttgcccaggctggagtgcaatggcacgatcttggctcactgcaacctctgcctcccgggttcaagcgattctcctgcctcagccttctgagtagctgggattacaggcatgcgccaccacgcccggctaattttgtatttttagtagagacggagtttctccaggttggtcaggctggtctcgaactcccaacctcagatgatctgcccgcctcgacctcccaaagtgctgggattacaggcgtgagccacagcccctggcccagatttccttattttttgtagaacttctttttctgttccaggtgtctgttcataactccacactgcacttacctctcacggctccttaggctctcttggtggtgacagattctctgagttttcttgtttttgatgacactgataaatttgaggagtaatggtcatacttggtaagatgtccctcgaatggaattgatgtgaattctttctctgattaggcaggtgccagcatggcccaccactgctgatgtggaccttggtcacctggctccgggagtctttgtcaggcttcttcacgtaaagttgctctttttttcccactttccacaccgtactctttggaacgaagcacctcgtgcttaaggagtggggatttaagcccactaggatagtttcagcactcaaaaaacgtatgctttcagaaagacaagcatcacatgttttcacttatttgtgggatctaaaaatcaaaacacatggagatagagagtagaaggatggttaccagaggctgggaaggggagtggggtggggggtggaggggatgtggtgaaagttaatgggtacaaaaaatagaataaatgaataaagcctagcatccgatggcacaacagggtgactataatcaataattcaattgtatattttaaaataactaaaatagtataattggattgtgtgtaacacaaaggataaatgcttgaggggatggataccccattccccatgatgcaattgttatttattgcatgcctgtatcaaaacatctcatacgcctcataaatatatatacctactatgtaccaacaaaaataaaaaatagaaatcctgcgctttacctatttacccctcccatcccctctggcaacaactatttttactgactccatagttttgcatttctttgaacctcatatagctggaatcatatgctatgtagccttttcaaattggcttctttcacttagtaatatgcatttaaaatttaaccatgtcttttcatggcttgatagctcatttctttttatggctgagtaacagtcacttgtgtgggtgctctctactttgtttacctcggttgctttcagttttggagtttatgaatgaagctgctaaaacacactttcatgcagcttttggtgtgaatataagttttcaaatcaattcttactaggaacttgattgctaaatcacatagtaagactatgtttagctttgcaagaaactgcctaactatcttccaatgactgcaccatttttcattcacaccagcagcaaaagagagttcctccatactgaatcctctccagcatgcggtggtgcaatttttgcagattttatctactctaatacatgtctacctgtatgtggtttcaatttgcaattcccaattgggaaatgatttcaaaaattattttaggttgccatttgtatattttctttgctgagttttctgttcagatcttttaacttcattttaattgagttgtttgctttcttattgtttaactgtaaaagttctttgtaagcttcagatataagttctttatcagacatatgttttgcaaatattttctccaagtctgaggcttatttttttattatcttgcaatgtctttggcagagcataagcttttaattttaatacagtttaacttacctatttttctttcatccaccatgtttttgatgttgtgttgaaaaactcattgccaaacccaaggttacctacattttctctattttcctctaaaagtttcaaagtgttgctatttacatttaggtttatgattcattttgagttactttttttctttctttcagctatattgaactataactgacaaataaaaataatatacattcaagatgtacaatgtgatgtgcatatactatacacgttcattgtgtaatggttaccaccatcaaattaatcaacctatccatcaccacagagttaccctttgtgtgtgtgtgtgttgtgataacacttaagatactttttcttagcaaatttctagtaaataatattattaactataattatcatgtggtatattagatactcagcaattatttatcttataactgaaagtgtgtacccttaaatcaacatctccccatttttcccacccctcagacactggcatgcactgttccactccttgcttctatgagttgcactttttagattcatatatgtcagatcatacagtatttgcctttctgtatctggcttattccacatagcataatgtcttccagattcacttatgttgtcacaaatggcaggattttcttcttttattatggctggataatatttcattgtatatatgtgtgtatatatgcatcatatatatgtatatacatgcatcatatatatgtatatacatacatcatatatatgtgtatatatacatcatatatatgtatatatacacattgtatatatgtgtgtatatatacatcatatatatatgtatatatacacatcatatatatgtgtatatagacaatagtttcttgatccactcatctgtcaatggacacaggttattccatgtcttccctattgtaaataatgctgcaataaacatgagggtgtagatagcacttcaagatattttatttcctttcactatccttttccttttctttggatatgtacctaggtataggattgttggattatatagtagttctatttttaatagtttgcagaactaacaatgttttctatataaattgactatatcaatttatatacccactgacagtgtacaaggattctcttttctccacatccgcaccaacacctgttagttcttgtcgtttggataatagccatccttacaggtgtgaggtgatgtctcagtctcactgtggttctgatttgcatttccctgatgattcatgatgttgagcagcttttcatacacccgttggacagttgtatgtcttctttgaaaaaatgtctgttcagggcatttgcccatttttcaatacgttactatcatcatcatcattattattattaatttgctattgagttgtatgtgtattcagtattttgaatattaacccattatcagatatatagtttttaaatatgtgctcccattctgtagcttggctttttgttttgttgattgttttctttgctgtgcacaagatttttagtgtgatgtattcccatttatttatttttgctttcatgctatgtgcttttggtgttatatccaaaaaatattgccaaggccaatgtacagaaactttttctctcttttttcttctaggaatttcacggtttcaagtcttacatgtaagttttcttttttttttttttgagatgaagtttccctcttgttgcccaggctggagtgccatggtgtgatctcagctcaccacaacctctgcctcctaggttcaagtgattctcctgccttagcctcctgagtagctgggattacaggcattacaggcatgcaccaccacgcctggctaatttttttttttcttttagtagagatggggtttcaccatgttggtcaggctagtctcgaactcccaacctcaggttatccacctgcctcggcctcccaagatgctgggattacaggcatgagccactgcgcctggcccatataagttgttaatcctatttcaagttaacttttgcatttggtataaaataatggttcaattttattcttttgcatgtggttatggagttttcccatcatttattaaagagagtatcctttacccatcgtgtattcttaggactcttctcaaaggcatttaatttggggctctctattctgttctaagagcctgtttttatgctagtatcatactgtttttatttactgtaccttggcaatatagtttgaaatcaggaagtataattcttaacagctttgttgctctttctcaaaattgctttgcctattcagagtcttttgtgattctgtacaaattttaagattgtttcttctatttctgtgaaaaatgtcattggatttttgatagggattacatcaaatctgtatatcactttgggtagtatggatctatttgcgatgttaattctttcaattagtgaacatgagctatctttccagttatgtgtgtctcctttaatttctttcatcagtgttttatacatttcagcatacatatctagatatttcacatgcatgattaaatgcatttctaactattttatcgtttttgatgctattgtaaatgggactgttttcttaattttttggatagttggttcttgatgtatagaaaacccactgacttttgtatgttgattttgtatcctgaaactttactgaatttagttattagttctaacagttttttcatggagtctttagagttttcaatatttaagatcatgtcatcttcaaaccgagataatttaatgtctttctttccaatttgggttccttttacttacttttctctcttaattgctgtggctaagacttccagtactatgttgaacagaagtggcaagagtgggcatctttttcttgtacctgagtttaaaagaaaagctttcagctatcatcactgagtatgatgttagctgtgggatggtcatatacggcctttcttgtattgaggcacagttcttccatatgtaatttgtgaagtttgtatcatgaatttatgttgaattttgtaaaatgcttttattgaatctatggaggtgatcatatgattgttatcctttattctgttaatgtggtatatcgcaattattgttttgcacattatgaaacatccttgcatcccaggataaatcctacttgattatagtgtatgatcctttaaatgtgttgttgaatttggtttgctaacattttgttgaggagttttgcatctatgttcatcagtgattttgtcctgtaatgttcttttcttgtagtgttcttagttagctttggtataaagataatgctggcctgataaaattagtttggaagtccttcccactcttcaactttttggaagattttgaggagaattgccatgaattcttcttcaaatatttgatagaattcaccttgaagccatctagtcctgagattttcttttctttgaggttttagattacaggtttaatctcctttctcattattgttctgttcatattttctctttcttcatgattaactttttgcaggttgtacatttctaggaatttattcatttcttctaggttattcaatttgttggtgtatagttgttcatagtggtctcttatgatcctttgtatttctgtggtatcagtggtaatgcctcctctttcgttacgttttctttattgtgagccatcttttttgttcttggttactctaactacagttttctcaactttgcttatcttttcaaaaacgcgactttagttttgttgatatttcctattgtgtttctagtctctattttatttctttttattctaatatatattttttaattttctgactttggactgagtttgtgctgcttttctggttttttttgggctaagtagcttgtatatttgagattattcttatttcttaatataggcatttattgctataacgtttgttcttaaaactgtgtttcctgcatcccatacgttttggtatgttgtgtttctatttttacttgtctcaagatactttaaaatttctcttttgatttcttatttgagccattgatttcaggagtatgctgtttaatttgtacatatttgtgaatttcccaaaatctcttgtgttattgatttctaatttcatacaactgtggtcagaaaagatacttgatatgatttcaacactcttaaatttgctaagaattgtcttatatcccagcatatgatctatcttaaagaatgttccatgtgctctggagaagagtaagtatgctactgctgttagacagaaggtcaagaccttctgttgggtccctaggctaatgggattacttctgagattgcagtcaagtggagtcagagctgagttacaactgctgctgggcccacagtggggaccatgtttagtgggcctcttcccaggtgctcaagctggcatggattatacctccatgactttggtcagtagggctggtgatgggacaagtgtctgtctactcagggtccatagttggttgttaccaggtgtgtataccggtgcggatccttctaggtccttgggatagctcctcctgggtcactgggtaagtccctgggcaggcatgactgcacaggtaagagtgactggagaagagttacagggccattttggagtctactgtggtatcaaggtaaacaagcctgcctccctgggtgtgaaagattgagcatgcctcctgggggggtctttgagtgggaaaaactgctctcagctcacagatgagaaggcctagagccaagttacaaaactattacaggaccttctgtgggtctgagattggtagaccttctctgaatgcacagatagctgtatctcctggcaagactgtgcttgggcaagaatgctctcaaaacacaattgagagggtctatggctgagttacaggactgcttcagagttcactgcccaggctgaggtcagcgagcccatcaccagagggagcagtgcccgtgactccaccccagtcctttggcagatgactgtggtagcaggatcaaggccaaacaggcttatagccgagcccacaaggagatgaggctgattccagacctattgcctgcaccaacagtcagcaagcctgccacctagatgcaggcctcccctttcctcaacctcctaggttttaagccagaccagggtttcacaacctcccacctggatcccaaaggctcttttgtctaaataaatctctcaatgtatttaaatattctttgattcctgtcatcagagtttagtagtttcctgcatatagattttgtacatattatgttagctgtttacctaagaatgtcatttttggtgccattgtaaatgtttttgtgagtataattttgaatttcaaatgtccatagttggtgtatggaaaacaaatgactgttgaatattggccttttatcctgtgatcttgctgtaatcacatcaataccaggactttgttttgaccatttcttaggattttatacataaataatcatgtcatctgtgtatgcaatagactgaataataattaccaaagctaaccaagtcctaatatttggaaccagtgaatattatgttacgtggcaaaagggatattgcacatgtggttaaaagatggggagattgtctgagattgtccagagtgcctgaaatataattgcaagtgtccttataaaagggatgcagaagtagctttgattatgggtaggagaaggcaatgtgatgagagaaatggtgattggagtgatgcggccacacttcaggggatgcaagcagccaccagaagcagaaagaagcaaggaacagactccactctgcaagtgaccaaccccaataacaccttgattttagtcctatgtcttagtctgttttgggttgctataacaaaataccacaaactgagtaatttataaagaaaagaaattatatttctcacagttctggagacttggaagtacaatatcaaggtgacagtatctggtaagggccttctggctatgtcacccatggcagaaggcaaaaggtgagagatggtgagagagctaagagggaagccaaactcatcatttcatcaggaacccactcccacaataactaacccactgccacaataatggcactaattcattcataagggaagaaccctcatgacctaatcacctcctaaagttcccacctcagcattgttgcattggggaataagtttccaacacatgaactttggggtacacattcaagtcatgacaccctatatgactaattttggacttttagcctccagaaatgtaatagaataaggatgtatcattttaaaccatggactttgtcataatttgctacatcagcaataagaaactaacacaatcaataaagacagatttatttcttccctctgtacctacacaatttttacttcctttcttgtcttattgtattagctatgacttatagtataatgttaaatgggagtggagggaaaagatctccctgccttgtccctgaacttagggggaaagcttccagtttcttaccacgaagtagtatgatgttagctgtaggttttttgcagatgttccttgtcaagttgaagctgttatcctctattcctatttgctgaaagtttatatcaaggatgggtactggactttgtctagtgctttttctgcatcaatagatattgtattagttcattcacacactgctataaagaactaccttagactgggtaatttatgaagaaaagagatttcgttgactcacagttctgcagacctaacagaaagcatggctgggaggcctcaggaaacttaaaaacatggcagaaggagaaggggaagcaggcacgtcttaccagggcgaccccatgatcccatcaccatcaggcccctcctccaattcgacatgagatttgggcagggacacaaatccaaaccctattattctgcccctggcccctcccaaatctcatgtccttttcacatttcaaaatacaattatcccttctcaacagtcccccagtattaactcatttcaacattaactcaaaagtccgaagtccaaagtctcatctgagacaaggtaagtcctttccacctatgagcctgtaaaaataaaataaaataattagttacttccaagatacaatgagggtacaggcattgggtaaatgctcccattccaaatgggagatattagccaaaacaaaggggctacaggccttatgcaagtccaaaacccagcagggcagtcattaaatcttgaaactccaaaataatctccttggactccatgtctcacatccagggtacactgacgtaaggggtgggttctccaagccttgggcagttccacccctggggaggagctgtgcagggtacagcctctgtggctgctttcatgggctggtgttgagggcctttggtttttataggtgcacagtgcaagctgttggtagagctatcattctgggatctggaggatggtggccctattctcacaactccactaggcagtgcctcagtggggactttgtgtaagggctccaaccccacatttcccctctgcactgccccagtggagattctccatgagggctccacccctgcagcagaattctgcctgcacaccaggtgtttccatacgtcctctgaaatcgaggcagatgttctcagacctcaattcttgtctttggcacacatgcaggctcaacaccatatggaagctgccaaggcttggggtttgcaccttctgaagccactgcctgagttgcgccttggccccttttaggcatggctggtgctggagtggctgggatgcagggttccatgtcccaaggctgcacagagaagctaggccctgggcctggcccactaaatcatttttcccttctaggcctccaggcctgtgatgggagggggtgctgtaaaggtctctgaaatgccttggagactccattcttggctattaacatttggctcctctttacatatgcaaatttctgcagcaggcttgaatttctccccagaaaatgggtttttcttttctatcacatggtcagtctgcaaattttacaaacttttgtgctgtttcccttttaaatgtaagttccagtttcaaataatctctttgttcatgcatatgactgtacatgtttagaaacagccaggtcacctcttgaatgctttgctgcttagaaatttcttccaccagataccctaaatcatctctctcaagttcaaagttccacaggtctctagggaaggggcaaaataccaccagtctctttgctaaagcatagcaaccgtgacctttactccaattcccaacaagttcttcatctccatgtgagaccacctccacctggacttcgttgttcatatcattatcagcattttggtcaaaaccattcaacaagtctctaggaagttccaaaccttcccacgtcttcctttcttcttctgagcccttcaaactgttccaacctctgctctttacccagttccaaagccgcttccacattttcaggtatctttatagcaatgccccactcccgtaccaattttctgtattagtctgttctcacactgctataaagaactacctgagactgggtaatttatgaagaaaagaagtttaattgactcacagttctgcaggcttaacaggaagcatggtagggaggcctcaggaaacttataatcatagcagaaggcaaaggggaagaaagcacatcttactgtggtgacgggagagagagagcaaaggggaaagtgccacatacccgtagaccatcagatctcatgagaactcactctgacaacaaaaaaagcatgggggaaatcttcccccatgatccaatcacctcccaccaggcccctcctcaaatttgacatgtgatttgagtagggacacaaatccaaaccatatcagatatggtcatataaattttatttttttacctgttgatgtggtagatagcattgttttccagtgttgaaccagctttgcatatctgaaataaattggttgtggaatacaattcttttataccttgttggattcaagttacaaatattttttgaggatttgtgtatttgttcctgagagatattagtctatagtttttcttactcttactaataatgatttatctgattttagtatcagagaagtgctggcctcatagaatgcattagaaagtgttccctctgcttctattttccagaagagattgtagagaattattgtattttctgtcttaaatgtgtgatacaatgcaccagtgaaactatctgatccttctgctgacattcttggaaggttattaactcctgatttattttttatacatattgacctgtaatgattatctatttcatctttgatgagtttggtagtttgcattttgcaagtaattggcccatttcatataagttatcaaattcggggtcacggagttattcatcatattattttactatcttttcacattgaagggattcctgctgatgacatatcttaaatttctgatattaataattttggtcttctctgtatttttctcagtctgactagaagtttatcaattatattgatctctttaaagaactagcttctgattttattttctcttattttccattttttatgttcatcgacttctgctctaattttgcttatttgtttgctttaggcttaaatttatttttctattcataattcccaaatgtggaagcttagattattgattttaaatcttcttcctttgtaatatatgcatttaatgctataaatttttctctaagtattattttcattgcattctacatattttgataatttgaattctcattttcagttaggtcaaaatattttgtaaaaatttttcttgaggctccttcttgacccatgtgttatttgaggttaatttataagcattttaggatttttgtggtatatttctgttgttaatttctattttaattctattgtcatctgagtttatattttatatttaatttttatttaaacaaatacgttaaatatgttaaggtgtgttttatggccaaacatgtggcctttgtgagtgtttcaatgtgagcttgagaagaatgtatattctgctgtcgttcaatgaattattctataaaagttaattagattcagttgattgatgtttcagttcagttcaacttacatcttgttggagaattagcctcatcaatctttgtgtaagtctctgctttatccctgctatttttttttctttggaagcctgctttgtcttaagttaatagctgccctgagagcatcctgaaagttggaatgggtatgtggggcaagactctgatgaagctgggatcgttaagcccctacattctgatgaatcttctttgccagtagaaacaactctccagcccagtaggaatggctgctctgaacctatttggggcaattaacactgtatagcctgaggtgactgcaatgggccccctgaggtagttgccatgcaaaacacagctgatttttttcaggacccaccccataactacactcacatcacaacaggactctaaaggcgaggtagaaagtgtgacccatgaagaggcgtgacacactccaagggaattagttgtgttttcttatttatacagacaaaaatccaggctatatgtgcagaaatgaatagtaagtgtgtgggctaatgagagaaagttagatcagggtaagtttattgatatgggcccactaagcagagactctgcatttaatattgtagcttggggagtcagaaaggactctaacagtttggttggtggacccaaaaagggatcaaaaggtggcccacagcaagggagttaaaatataaatgccaggtgtgccttggtttaatgccgaagaagggattaaaggcttaaagacattgggatgttagagtggattttccatttaagacctacttatatgccctgggaggcttcaaaagacatacctttcaccaaaatggtgagaaataaatttttgaggagagcctcagcatccttgatgtgtttgttctctataggcaagatttttagtggaaactagagtcactgaattgggaaaactaaatgtaatgggagtaactggatcccaggttggcaggagccaagtaccagcattcagccaccaaaatccaggtgggcctagctgacacagtggacagcaatgtcacagcagccactagaatagtctcactcgtggagacctatggcattggctagttgatcatggtgctcctagaagtgaaatagataggaagccaactaaattcttacttgatctgtataagcagaaaaagttgtaggtcaagtgaataaaagtctaactctaatactgaaaaacagagaatcatgatccctcaatcaattatcagaggcaaagtaaggcctttattcttcctgtaagggataaaagccaagtccccttgaggaagaaacccatgacactgccaaaaatttataatgttaatctctttctcagccttccccagaggagcttatggccttttaacaagatgactaagcattagggaaaagtaaataatcagacattttggtgactgctggacactggctctgaattgacactaattcctggtggcactgaacaccactgtgactcaacagtcagagtaggggttatgcagatcaggtgatcagtggagttttagctcatcttatagtagattcaggtaatctctgaacccatcctgtggttatttcccagttccagagtgcataattggaatggacatattcagcaactatcagaatccccacattggttctctgacctgtggagtgagggccattatcataggaactgcctgtacctaaacaatgtaaaccaaaagccatactgcattcttggagagattacagaggttagtgctactctcaaggactttgaaagatgcaggcgtggcagttgctaccatatccacattcaattgtgctatttggactgtgcagaagacagatggaccttagagaatgacagtggattcatgagcttaatcaagtattaactttaattgtagctgctttagcagatgtggtttcattacttaagcaaattaacacatcccctggtacctggtatctgagatctggcaaatgcctttttttttctgtatctgtttcgaaaggccattagaagcagtttgctttcaacctgcaaggccaacaatacaaattgagtgtcctatcccaagggtatatcagctctccagccctgtgtcataaattcagttcatacagaacttgaggccttttccttccaccagataccacgctggtccattatcttaatgacattatactgatttaacctagtgagtgtgaagtagcaaccactctgaacttattggtaagacatttgcatgtcagagggtaggaaataaatccaactaaaatgcaagggcattctacctcagtgaagtttctaggggcctagtgctgtggggtgtgtcaaaatatcccttgtaaggtgaaagagagttgcaacatcccgtccctcctataaccaagaaagaggctcaaggcctagaggcctcttagtattttggaggcaacgtattcctcattcaggtccaacccatttacaaagtgaactaaaaagctgcgagttttgagtggagcctagaaaagagaaggttctgcaaaaggcctacattactgtgcagctgctgtgccccttgagccacatgagccatcagatccaatggtacttgaagtgtcagtggcagggagaagtgctgtgtggagcctttggcaggcccttttaagtgaatcgcagtgcagacataggactctggagaaaggatctgccatcccctgtgaataactactgtctttctgaggaacagcttttggcctattcctgggcccttttagagcctgaacacctaatcctggtccatcaaattaccatgcaagctgagttggccattatgagctgggtattttcttacccaccaactcaagaggtagatgtgcacagtaacaatctatcgtcaaatggaagtagtatatgtaagattgagcttgagcaggccctaatggcacagttaagttacatgaagaaatgacacaaatgtccatgccttccatagaagcctgaacctatggcctcatggagagttccctatgatcaattgtagaggaaaagaatctcaagcctggtttacagatagttctgcagcatatgcagacactaccgaaaagtggacagctgcagcactgcgaccctctctggatcattcctgaagaacactgataaagaaaaaatcctctccatgggcaaaacttcaagcagcacacctggttgttcactttatttacaatgagaaatggccagcaatgagattctatactgatttatgagctgtggcaaatggtttggcttaatggtcatgtccttagaaggaacaatataggagtattggtgaaaacgaagtatggagaagaggtatgagagtagacctctttgaatgagagaaaaacatgaagatatctgtgtcccatgtgaatgcttaccaagattttagtaataaaatggatagaatgactcattctgtggatacagtcagtttctttccccatccacatttgtcatagtccaatgggctctttgccattgtggcaaagatggggattatgcatgggcttagcaacacggacttccactcaccaaggttgacctgactatggccactgttgaatgctcaatcagtcagcagaagaaacagcactgattacttgatacaggatcattcttcgagatgatcagtcagtaacctggggcaggttgattacattctattgcttccattatgggaaaagcagggttttgtttctactagacaaggcacttaccctgaatatgtattttccttccttgcatgcaatgcttctactaagactacaatctgtggacttacagaatgcattagtcactgttatgttattccacacagcattgttgctgatcaaggaactcacttcacaacaaacaaagtgcagcaacgggctcatgctcatggaattcattggcctttctatgttccccaccatgctacaaaagcaggcttggtaagatagtggaatggctctttgaagactcagtcacagagtcagctagatggcaataccttgcatggctgggacaaagttctccaaaaggctgaatatgctttaaatcagtgtctaatatatggttctgtttctcccatggccaaatgcataggtccaagaatcaaggggtagatatgggagtgacacaactcaccattacccctggtgaccactagcggaatgtttgcttcctgttcccatgactttatactctgctgggctaggggtcttagttccaaagggaggaatacttccaccaggaaacaaagtgattccattgaacctgaaggctgctgtcacctttctcagcacacaaatgatggggatgtaaggctggtgctcatggaattgcaattgcctcttgtctttaaaggcagttaatttctacccagtttctgagactgtggaaggaaagcagacaaggtctctgcttgactagtagattttgctcttccccaccctcaccataaagttcaaaggcacaaactgaaaagattttgaaagctggctcaaagcctttttcttctgttaacaaaaagttagagtattttgcttgggaggatcagtttcataattgtatcagtgctcctattctagaatttctagagccaattcttcagtaatgggcatctcaagcaagcacatgcaagttgtatgtttattaacaatttttttttaaactggcaatgcttctcatgttcccttacagagggaggaagacatatctggagagactgtggaaagagcagaagaaaacataaactgattacacccacagaacaattgctgatggaacatgaaggatgctttagggaaagcaccctgatgtttcacattcaaattgcctcatcatgtgtttttaaggtgctgcctgtctccaggcacagaggtgcctggaactaaaacctcagtgtttgtcctctctgtattatccttggctccagagcaaggagagagttccaggacaggtgtgtacagtgtttgcaggtgaatctgcatgttggtctgtgcactcgtttctcctttccaccccagcagtcagtggtgatttataagcatccttctgcatgcccttgtgatgtgagggaaagagcagaaacatttggtttagaaaataaatggagtctaagtaagaccttgagcctttagtgggttagttgtcagcttttggacagatccctttaccttcttacccttagctttctcccctatgaaacagggccatgatcttgtaaaaggatgaaaatgacatgagtaattgcaaataattataaacatcagggaaaattcaatctacatctactacgccttccattccttttcaactatgttatacatttcttttaactttagctattcatggtgcaagggatcttccagatctctagaaagctaattcaaagactgacattagaaaactttacagaaaaaaaaagattaaagagttgcaggcatgggtgcaaagagcaacatagctgctaaaggaagcttgaaatctttgtctagtcctggggacccagctggagttgtcaggaatcagcagagcaggtgttcagctgaggtttggaagaattcttagcccattgaaatactttatgggccgggcatgatggctcacacctgtaatcccagcactttgggaggccaaggtgggtggatcacgaggtcaggatgttgagaccatcctggctaacacgatgaaaccctgtcactactaaaaaatacaaaaaaattagctgggcatggtggcaggcacctgcagtcccagctacttggaaggctgaggcaggagaatggcgtgaacctgggaggcagagcttgccatgagccaagatcgtgccactgcactccagcctgggtgacagagcgagagtccgtctcaaaaaaacaaaacaaaacaataaaactttataaagtcctgatgcggtggcttatgcctgtaatcccagcattttgggaggccgaggtgggcagatcacttgaggtcaggagttcaagaccagcctggccaacatggcaagaccctgtctctactaaaaatacaaaagttagccgggcgtggtggtgggcacctgtaatcccagctacttgggaagctgaggcaggagaatcgggtgagcctgggaggtgaaggtggcagtgagctgagatcacaccactgccctccagcctgagcaataaagtgaaactctgtctcgaaaaaaaaaaaaaaaaaaaaaaaacttcataaaaatgctaaaatatttatccagaatgctcatttatttctaggatgaggtttatgcatttcatcatgcaaaaagttctgttcaggtcaggactagaacaaatattaatatatatttacaaatgtttgcaatgtacaaaaggctctgttagtgatctgctgtaaagaaaaagaaaggctgcatcagcctttgaagttttgtttgcctttgaagctggaggaagtcatattgcctgagtgctgctcttcacattaagaaggtagggccacttgagggacaccatctgacaggctgcaatctaggagagacctacagggttccaaaggctcagtgtgctaatttctgaaacaggatagaacctcccatcacctcagagcgatgggacggcaggcaggccttggcgagcctcacttcatctccaccctcttcatgaagcccctgacttttagttctctgcctaacagtccagaagggactggccatttccagctaaaggtcaggctgtcttaggcatagttgaagtaacagaatcatccttattgctggttgcttttttcacttttatttctttatttcctcttctcttgaggctttcagaggcacattttggtgagagaaaataagtctaaacatttatgaattagaaatattggcttctggcatccttgtgccagttgtgtgggaatctatttcttaataagatcataattaagagcacggttgcagattgtgactgtgtttacaggggccactgaacttggcctgtaaataacaaacaaagtcataaaaactatccagagaataaaaggtgcatcctacagtgaagccctaagagacagtagtccccaggctggctggagagcagcacagtagccactctgctgcagcgggaagggattgaggagatgtcacggagtctgagtggcagagccagggccagatccagcccatgaggtcacaggctgaggagtttctgagtttcagagccacaggcacagcccaaccccaggactgaaagatgccagttactcatccagtccccaaggagttcctgccgctgacctttgagagagaagaccccagggaacaagcctttcaccagaagggggaaactggagcttgagtagctgacattaaatactcatgttgtctttggttatagatttaatctccctgactctgtttatttttcgtttttgtctttcatcatgagtatgtggtcctaaagcagtgaatctcaaactatgtttctaaagcatctgaacctgctgggaaatgaaaagttacccactatttaatataaatatacatgcatatacacatacacatacaaatgcatgtacaaatacatatgcaaatacatgcacaagtgcatatacatgagcatgtatccacgcatatcatatacatgtacacatacacatacatacatatacacatatagacatatgcatatacatagacaaaagtatagctgttttggctgaagctccggtctcactcactcaactcacactcaccctctccctcgtctggccttcatagtgacacctaagcaccctcacaaaaagcctaggctctgcccaactccactttaaaaccactgagctttgattcagtcaaaagcttgtcctcaccaaccagcttgccagtgaatctgaaaatgtggacctttgcgtgagtcagtgctttctgacatcaaaatctcttgaaggaaagaggatcgttcccctattttaaagattgaatttggcaaaaaatttaaaaaaaagaagtaagaatttcaagccagatggaaaaaatctttagggctaaacaaaatctcataaaatgaatgaggaggaactaagcataaactatgtgatattaatgggttagagatgtgcagaagtttagggaagatattatacatgagcagagcatttagagattgatgggtttctggataagtggagggaagcagtgtaggaggaaaaagccatgggtaaaataaaagttcctgatgatcacagatgtcacaggactggaggagtttgtgctataaaagggagagggatcgtagttgagataatgagaagatgagagagactcgtaggagcctcattatggaatctacggagggctgataagggcagggctgatcctgtcactcagataggatgtagaacgctatctctgagtgggacaagaactctgccaggctggttcaggaccgggcgagtgagggtgaggtcttgctcagcattttcaatgagtgggccaatcagtggctctatgaaaatggcagagattccttccttggtccctgttggatagtcacctcgtaaaattgatcctaatttctgacaactactcatgaaatatgcctgcattttcccatgccaaacatttgcaaaccatctatttgaaaagtttaaatggatattgttaactgaaaaaaaaaaatccacaatttttaaatttagaaacggaaaggagacttttttcttataaagggttacatcctgcaaggtggccaacctgcaggctgggaagcatgcctctggctgaagcccggagacaggcactttgaaggagaaggggttgagttgtagaagcttcattctgaataggttgactaaacacacatattcaacaagttacaggaggagctgtgaatattcatgaaggtggtcctgacacatgcctagtgaacaaacatgcatgtaacatacaacccatattcaccttggggtggagagttaccatttaaatttgttacagtttagccctatatgtcaacaggttttatcaggagacaaaggcacttaagtgtgcaacctctgtaaaccagccagaaccagtccatgattggtgggctcttatcaggagaaagttactgaaatcagtctcttgtctgatcgaagctgtaactatggctggtggaacaggagtttagtgagtgagtgtctgtctgtgagctggatggattgtgattgttttaatattgcttacgttgaggctggggcttgtttagctgctagagaaaaagaaaaagctgtgagaacatagtttatcctttcagtgtaggggtgtgtgacttacctcttgcttggcatggtaggtcctgtttataatttggtatcttatggccacaaagagtctgttctgtcattcttacagtctctattttaacattaatgctggctgttgtgactaaaccgtaaaagggaaggggcataacaaggcatgtctgatgtcccatcctgtcatggccaggaactcagttttcaggtttctgtgggctctccttggccacaatggggtctgttcaataggtgggagagtctggattttatatttgtttatttagacagagtttcgctctgtcacctaggctggagtgcagtggcatgatctcggctcactgcaaccttcgcctccccagttcaagcaatcctcatgcctcagcctcccaagttgctgggactacaggtgtgagccacaacacctagctttttttttttttttttttttagtactttttagtatttttagtagaaatgagatttccccatgttggttaggctggtctcaaactcctgacctcaggtgatccacctgcctcggcctcccaaagtgttgggattacaggtgcgagccactgtgcccagcttggattttatttttagtttacaacatgcatgcccacacttgcacatatatgcacacatgtgtgcacacacatatttataagaagaaaatatggacagctgctacagtcttcatttctggccacagtatcgtagctaatatttaactcaactagttggggatcctttttcttgtcgggtgacccaaaccttaattcccaaagggtgtgagtccttagcagtcctgcctttgtgaggttgctattattgtccatttctatttccaaaggctgacaaaataaattaccacaaactgagtggtggctcaaaaaacaaattgattttgtcacagttctagaggctggaagtccaaaatcaagatgtcagcagaatgcattccttctggaggttctgaaagaaaagcctccctaggcccctctcctagctctgatgctgctggcacgtcctggtaattttttggcttgttgcttcatcattccagtatctgcctccattgtcacatggcactctttctgtgtgtgtctgtgtctcttctctgtttcctttttttttttttaagacggagtctcactgtctcccagggtggagtgcagtggtgcgatcttggctcacttcaagctctgcctcctgggtccacaccattcttctgcctcagcctcccgagtagctgggactacaggtgcccgccaccatgcctggctaattttttgtatttttaatagagacggggtttcactgtgttagccaggatggtctcgatctcctgacctcgtgatccgcccgcctcggtatcccaaagtgctgggattacaggcgtgagccaccgcgcccggccttctctgtttcttataaggacgatagtcacatggactagagcccacccttatccagctcatctacccttgatatcatttgcaaagactgtactcccaaataacatcacgttcacaggtattgggggttaggactttagcatagctttttcgggggacacaatctagcccacaaaattgtccactaacattttctattatgtgtggcagagccaagaagcactcaagagcatcccctgggtttttagggggacatggttcttcctacctcccttgtgagcagaaacccaatttctgcttagggatcagccaggacagttactctattctttatagtggaataagaagcctcaaatgacagaataaagcctcagtatcccattcaacagatacagccttattttctccagcagaagcacttctgtcttaggaactagaatctccaaaccagcaaagcacaagattctggagggagaagcaaaaatcctgcagaagaaatatgagaagagccatttccaattatgcctctttgatttccagactcctgtattctgttgattgattgctgcttcaaagcatatactacttccagaatgctgtcactttatgggcgctgtaactgagtattctcaggccattgtgccattatatcaggacaaggcagaaattggtggaggtcagtgttacaatctgcttgccctatcatgtggctgagtggttcccccgggaagttaatgctgctgaacccttgagtggcttctatcaccacttccttagccactttatacccagacccattgagcaaacaccccggagccttccagcacacccactgaatgtgtcatcacatccccctgattcctgaaagtctcctgtgtagcagatgaccttcagggaacattcacgtgggacacaggtatgccccaccctgtgtcccttctgagaagtccatttacacatctcttcttcagtctgtcactagttatccaatgccattctttcccagtctctgaccatctactcagagaaccacacatgaatttgtgtagatctgtacttctggccatctgttacgcagataaaatgaaaaactaaattttactgctacaagttttgtccactgggaagctatccttttccctttgttcttcagcactatccttgagtgagacagtagcattggcagcgatccacttatggctggtgccagcataacagaaccatctgcaaaccagctgccgtaggcaactcccaatgaggtcctaagtgtaaattatgggaagaaaagatggagaagaaggaaaagatggaatcggagtccttagcagtcacctgctcatgaaacctgtttctggacttgccgaatcttattctcctcccaccttatggcctagtgtgtcggtgcatagccaattcatgatgaacagtggtcatgaagttctcattttgtcttgacaaagctcagtagcatagcaagataagagttgattcttaaaataataattatatgcagagtagaacatggcttttctccaaagccctatatatttgcattgcgattctcatttgggcttgccagaagctcctgaaaacagatattcaattatgcttttatttatttatttatttatttatttatttatttatttatttattttgagacggagtctcgctctgtcacccaagctggaatgcagtggtgagatctcagctcactgcaacctctgcctcttgtgttcaagcaattctcctgcctcagcctcccgagtagctgggactacaggtgcccgccatcaggcctgattaatttgtgtatttttactagagatggggtttcactatattggccaggctggtctcgaactcctgaccttgtgatccgcctgcctcggcctcccaaagtgctgggattacagttgtaagccaccacacctggccttcaattatgcttttatgtgtgtccatatggccccagtcacttaccttggagctttgttggttactcaataaatgggttgggacagcactctcaaatgtggtatttgttgcctccaaagacattttctcaacaccgtgcccattttttaggggtaggtaatagatgaaataacaacttctgtttcactttggaagaaatgcccaaacatgcttcagaccacagggccatgagaaacctccccaaggcatgggcctcgagatttcatggggtttattgttcactctttgccacacatgtgtctcattaagacatttagggttcttgctgtgcttgctcaccagattcaaccaagatggtgtcctgggtatggtggaagaagatgttctctgggatgcagagatttccctgaacaagtccatcacagagagcaggagagtctggcctcttcagatgtgagccatcattaagttcaaattcactccaccatccatgcaaactgtgagagctgctccatggtgcccaaatcagcacattcagctagaatctctgtaagtgctctcacatggatggggtcagccttattcagtgttgaattctgtgctctgtggtgtaatgttcttaggattcatgcactacatttacccatgtttctggtactttgaattggtgagtattgccctttttatcatttttcttccctctctcttttttttctctcctataaaccatgtccttctggattggactttgcttttctccctgtggaacatacttgacatttgtgaccctaattatgggtctcatgcactaatgggtgatgggagtgagccctgagagttttagatatcaccttaccagggagctcaagcatgtgaagttattaaaaggtcttcaaataagggaagattctacaggcagggagaggaggctgcttccttcagcaaggatggcttagagagacttggggtgtaaatttcccagcttttcttgaatccacacagataacccaattccaagtcttggagagccccctgctacaatcaaagcctaacttttacacaaatgtattggcgagtctgaggattgaacttacactgtaattttgtacctactccattaaattctgcatctattttatacagctctatctgccttgctgcttgtaagtaaaacaaagatgttttgttttggttttagtgtcactggagaagctgtctgattctctgaacatgacgcaagccttgctgtcaccaccaccgtgaaggtcagatacagcacccaaggtacttgctgcaataggcctttcttcccctgcaactgaggtgataattgaatcataataccactgcacgccttgggttataggaatcccgtttcccactcagcattgcattcaagacaaaggacataccaagtcaaccctaacatctcacatcagatgttcataaacggctcacattttctgtactttatgcatatttttttactcataaaagagtcaaggggaaacagctttgaagaaggagcccaaatgatattagcgttcatgcttatttttagacttcaaaaagataggtatctaaacactacttactggataaatgtaagggtgtattttagcctttgtagatttcctaacagtaattattaactatacaaccatacgaactcattattaagtacttagtgtgcttttgacatcagctccatctcgatttctttgaattgcatgagctgttttgtaggacagtacacatctgtcctggaagtgtcccagagagccagcaaacccctcacctgctggactgtggctgtgttgggaacctgtctacgtttaaaactccaatgctttgactgagtggtattggctggataaaatctgtggtctttgtgagctctacaagggcaaagctggttaacttgttcatttcaaaggagtaatcttaatattgttaatgtggcttgtggcatcaaggttattagaatttaaggacttaatagatttctccatctactacatcaatggtaattgtagaaattagctaaaatgcactactgcttaaatgcaatggaaaaatatttctttcttcctttcaagactttaagaggtctgaaatgtttctgtccaggcccttgcgcctctgccaccgctgtgagaagtacatatcctggccagcctgctgactcaggaggttgagaatcaggtgcagcagaccagagcactgcttcagtgtcagggtagagctgctccatgacccagagattcatacgagtaagttattttcctcaagaccagtgagtttgttacacaacagaattgtggccatacccaaccaatacagcatgaatcttttccattacgttactatacaattacacaattgatcgttctatatgcattgttttgttaaactgcatgtcttagggatcctccaaggttagtacctataagccaaacttattctttttaatggctgcagagtattctgcagtatggttatagcaaaacttatttattcattcccctgtcgatgaatatctaacttcccaatctctccttaaatcaacaatgctgaaatgaacatttttatgtatatatgccttttcacacttgggcatcatatttaagatagattcctgctgtaaagtttatgaatcaaaatatgtacatatttaaattttgagaattactgccactttttctgaaaggctacacatttgcactcccaccaatgatgaatgagaacattgattaccctgcctcttctaaattaatcccagcctaatagatgaggaaaaagtctcatggttgtaacatactatttcttgatttttgagtaagtttaacacattttcatatgcttactatgtttgactcttccgagagagtatgttcatggtctaaatttttctattaaaatgtttttctttcttatcaattttaggatctctttatatattcttgatattcatccgtattgattaaatatgttacaaatattatctaccaatctaccacttgcccattgactttacagtgttttgctttttcactaaagaagattttaggtttttatgaagacaaacgtttcattagatttatgtaggacttttgatttttgcacattgcctagaaatacttgtacttcacttcaatataatgaaaccactccgtatattttcttttactaaatttacaatcttaacttttatctggcatttataccattgcactattatgaaaacactctataatgttttctcctaataagtttacagtaccattttatatctgaacattttttataatgtaagaaaaaatttttcctatagatatctaattatctccaaattatttattgaatgagctattcatttactattgactttaaacaccattatctttgtcataagctactatctcattaacagaagagtatattaatttttaaagagttttaaaaattttatagcaaaaacacataaaatttacatcttaattgtttttaatgtaccgtttagtagtattaagtacattcacattgttgtgcaattgtgaccaccatctatctctagaaattctttaatttgcaaaactgaacatgtacccattaaaaaataactcatcatttcaccctcaaaagggtgaaaatcctggaaagcctggaaactgccagtgtactttctgtctccatgaatttgactactctatgtatctcatataagtaaaatcatgcagcattctttttatgaccagctctttcacttagcctagtggcttcaagattcatccatgttgtagcacgtgacaggatttccttccttttttaaggatgagtaatattaaggatatatttctaaaacctcgagcctgtttatctgttttatttttctactttggtacaatactacaatgttttaaatacaacagatcaatagtgataagaaaaagctggtatagttggatatttgtcccctccagatctcacgctgaatttgatctccagcgttggaggtggaggctagtggaaggtgcttgggtcacgagggcagatcccttgtaaatggcttggtgatatctgcttggcagtgagtgagatctttttctaatagttcatgagagagttggttgattaaaagagcctgagctccccttccctctctcaccctctctctcgccctctctctcaccctctctctcgctctctctctcaccctctctcaccctctctctcaccctctctcactctctctctcaccctccctctcgctctctctctcgccctctctctcgccctctctctcgctctgctctctctctcaccctctctctcgctctctctctcaccctctctctcgctctctctctcaccctctctctcgctctctctctcgctctctcgccctctctctcaccctctctcaccctctctctcgctctctctctcaccctctctcgctctctctctcaccacaacataaacctgctccccttcaccttccactggtggtggaagcagcctgaagccctcaccagaagcaaatgctgacaccatgcttcttgtacagcctacagaaccatgagccaaagaaactgcttttctttataaattacccagccctaggtattcctttatgggaacacaaaatggaatgaaatacaagtaaatttgccatcttatcgttctctttgtaaaaatgaattagacattctccactgctgtggtctgaatatgtcccccaaaattcatatgttgtaaacgtaatgcccaatacaacagtgttgggacatggggcattttgagagatgtttaggtttcttcaaattgatatcattataaaagggcttgaaggagaaagtctggccccatttcacccttccttcctgatatggtttggctgtgtccccacctgaatctcatctcgaattcccatatattgtgaaagggaaccggtggaggtaattgactcatggaggcagatcttttccgtgctgttctcgtgatagtgaataagtctcacgagatctgatggttttaaaaatgggagtctccctgcaaaagctctcttctcttgtctgctgccatgtgagacatgcatttcactttctgctgtaattgtgaggcctccccagccatgtgaaactgtaagtcgaataaccccctttcttttgtaaattgcccagtctcggatatgcctttgtcagcagcatgaaaacggactaataatacacttttcttctgctatatgaggacacagcatttgtcccttctggaagatgcagcatccaaggcaccaccttggaagcagagaatagccgttacccgatagttaagccagccagcacctcagttggacttaggctgtagaacggtcagagataaatttctgtcctgtattaattacctagtctcagatattcagttatagcagcacaaaactgactaaaacatctgccatatgaattttaaaaaccttttatcaagttcataaaactttcagttaaattgaaaattttctttttttgggggggtttattattatttttattttttattatactttacgttttagggtacatgtgcacaatgtgcaggttagttacacatgtatacatgtgccatgttggtgtgctgcacccagtaactcgtcatttaacattaggtatacctccaaatgctatccctcccccctacccctaccccacaacaggccccggtgtgtgatgttccccttcctgtgtccatgtgttctcattgttcaattcccacctgtgagtgagaacatgtggtgtttggttttttgtccttgtaatagtttgctgagaatgatagtttccagcttcatccatgtccctacaaaggacatgaaatcatcattttttatggctgcgtagtattccctggtgtatatgtgccacattttcttaatccagtctatcattgttggacatttggattggttccaagtctttgctattgtgaatagtgctgcaataaacatatgtgtgcatgtgtctttatagcagcatgatttataatcctttgggtatatacccagtaatgggatggctgggtcaaatggtatttctagttctagatctctgaggaatcgccacactgacttccacaatggttgaactggtttacagtcccaccaacagtgtaaaagtgttcctatttctccacagcctctccagcacctgttgtttcctgactttttaatgatcgccattctaactggtgtgagatggtacctcattgtggttttgatttgcatttctctgatggccagtgatggtgagcattttttcatgtgtcttttggctgcataaatgtcttcttttgagaagtgtctgttcatatcctttgcccactttttgatggggtggtttgtttggttttttttgtaaatttgttggagttcattgtagattctggatattagccctttgtcagatgaggagattgcaaaaattttctcccattctgtaggttgcgtattcgctctgacggtactttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctgacatttaagtctttaatccatcttgaattaatttttgtataagggttaaggaagggatccagtttttcatgagatgtatagattaacctggagataatttacattttccatgactgtatctttcagtgtaggtatagggtatgtctcctcttattttttttttttaacattcttcaacaaagtttacaattttattcacatcagacttgtatactctttgtcaggtttatggtagaatttgctggcaactcttcaaaatttaatcaacccttttctttgtgcaagcagttagattcccttcccagcttcccttgcaattagttggggtcatatgactgaggttgtagttagtggaatttgagcagaagtgatggatgttacttccaagccaggaccttaaaaccatcccacactttctctaagctctctttccttcctgccttggatgacaactcccagggtgatcttgggagaaacctgtggaaggtgacagaacccctgtgtccctgaatgatgcagtggagcagagtcccaacctccccctctggactgctgccctgggcttttggatgagtgaaacatgaactgctcttggatggagttgttacacgtttgagtctgttactacagctgattctaccctaatcagtatcaaaccagtgaccttaaggtgtgatgccacagatgagccctgaaatacatgaatgccacttccaggccaccccataacaaccttacatacacactcttccatgctttcctcctctctggctaaccaggattgcaactccatgatagccttggaagcagggtataaaagatggcagagtcgctgctcacctgtgcacccagagcctccacacctgcctggaaccacctggaacgtcacgttgctaagggagttgttagatattggggtctctgtaatgctagaagaggttccatttagataataaaagttcttctttggggttttgtgtgcatttaaacaattggtaatggcatttgtttctttctatcatgttttctaattggttattgttagtatttttaaatgtttattttatatcagaccaccttactagttaatatagtttatcagttaattctgtgaaattttggggtagattatcagataaaactttttaaaatggcagttttgtcttttcttcatgctgtctgtacaatgtttctgtatttactgctaagatttcttattcactgtttgcataaaagtggtgctagtaggtgtccttttcttgtgtataattttaacatgaatatttatgatattttgccattagctattatgtttgctccagttttctagatctctcttatacaaaattaagaaagttttcttttatttctaacttcactgttttgctttgtttacatttttatcagaaatgtaatcaggatgttggttttagcaaatgctttcttgatattgattgagatgatcttgttttcctcttttaatctgaagacatacagaattgaattaatagattttgaaactattgaatcatgtttgcatatctaagtcttgattttacaagacacacacatttttaaaaatcattattctgtgaaatttgctaagattttttggggtttaatttctgcagctctctgtgttagtgagattggctgatctcatttagttttgtgtcagctttgtctagttgtggtgttagttttatactagcctcacagaataaggtagcagccttcccatattgtttgatgctacagcaaagtctgtatcacacagggataatctaatctatgagctaaagtttcataaaatttattaactcaagaaaatccctgaacttggtttcattattatggatagatttttttctttttattatcttttaaatttggtttagatgcttttgactgtttgaattttgtttcttattaagttaaaaatgataatttatagtgttctcaaaaactgtccatttaatctagacattgaaatatattaatttaatatcttatattttaaatatatttatatatttataccagcttgcttttaaaattatatttgtatttatattatattacaaaatatttttaaatgctcttttcattgcaaagaactgtctttttattttagtgatgaaatctgtgaattttagctgctaaatcattttgtttaaatcttattatattgcttctactttctttaggttgttttttctttgatttgattacatttttcaattatggaaaattttcagctgttagctccaaatacctcctctccattctttctctcctagaactcttacagattgtgcattctatcattaattcctcctaaatgatcattcccagtcgccattttttatatatctgctgtaatctgagtgatttctcagtgctaatgtctacctcactgattctctctgttgctatttctatgtaatctgttgaaaactgcatctattgataaattattttcttttttgctatcctttcattctttacttttagtttatttgttttatggaaggaaatatggcttgtatcatttttgcttttaggaatgtgcatagcttttctttgcagccagacacataatctatttttgtgcctatctgggtagggaggatttcaaaaacacctggaggcaagaatagggaacattaactgccttaaaaccaggatcagtcctggctccccaggggctcagctcattggctccagacaagagttctgatctgaacatctgagttaagaaaaaagacctcatgtgtcttcctgtgccatcctgctggagcaagagccaggagacctacaggagcgctgcttcctcctcccttttatgcgcttgtctcaagtctgttttggaggccattgcaaaggtgctgcctgcaggagccagccctctgggcgtgtggagggaagggcacactgactaagctgcccacaggagggaagtgggaccaaggacgtgggaggaagctcacatggtaactatggggcataaggcattttgagaaaagcaagactttgaggaggaatttttaggactaaagaatagcatgagtgtctggaaatcctagggtaaagagcaactcataaggagaaagagaaaggtgggagagctcagaggcaaaagtctattcttacctgtgccctggactggcccttccctaccccatttcctagacaccgagatagaatttcatgctgctcacagtgtccggactgcaacacaccatttctgtgtttcctgtagttaggtggagttgataatttaagtaacagacaaaactaagagaccccttggccagtctcaggcagcaagcacagtgtgtgccctttattattttattttatttatttatattttttgagacagagtctcactgtgtcgcccaggctggagtgcgatggcgggatctcggctcactgcaagctctgcctcccgggttcacgccattctcctgcctcagcctcttgagtagctaggactacaggcgcctgccaccatgccgggctaattttttttttttttttttttttttttttttttttagtagagacagagtttcaccgtgttagccaggatggtctcgatctcctgatcccccctcctcagcctccaaaagtgctgggattacaggcgtgagccaccacgcctggccgtgtgtgccctttatactagtaataggcacatgtgaattttgtccacacttatgcagaaatggagaaagaagcactgcagtaaacacctaagaaacagcaatcagaaaggttgtgggcaaagctcgatattcagatgtgtcctggactcccctccagtatcattttaattacaaatcatccatatggaaacctggagactgttttaactttccttttcagtttttagttatatcttacatcttatatcactttctaaaattgaataacctggagattaatttatttgcttgtcacttttccattagaagcttgaattcatttctgttttcattaccagtacacagtggcttgtcccaaattatcttcacccaaatcctacctggatgaacttacagcattttaataaaaatggttatttgctctgggagaaaattgtaatgggcaaaataaatctccttatctttgaagtagtttgaatgtgagatcacagtatgtcctttctgttaatacttggctgcaggataatccatgattccttctttaaaaaagttcagtactaaagttgttatgcaacattttattaaaagataaagtgctcccattcttcatatatactccataaactgctgagatgtcaaagtgctccataaataatacaagcttcttgcccatcattaacaaaagacgctgctaagtggacagaaaattcagtaattcccttttatggagatcacagtacatacacttagtccaatttgctgaccctgccatcaaaaattactgtctgcagaaaccctggcctggattttttcacactgaaaaatggagagctggggattttaatggaagacgctgaacactggttaaaattctgccttcacttgagaactggtccactgagaaaaaattataactattgcttcccttccattgagaacacactcttctatcaaaggcattctgagccaggaatctgagctctttcaagaaatcagcttatagtaaggccaaatgaactgctaagtcagatcccagtgtgatgatacgcatattcccatttatgatatgtcatcaatcatggctcatgcctcttgattgcactatgataaatatgccactcaagcaggttcatcgtacatcagagccagggaaggcagcttgggaaatgcacagggtaatgggcaacttggaaagtgtgcaaatccagacaaggcaggtgcctgcaggacaaatcagccaaagccaaccagatgtctgggcacctggtgtggacatgctttccctcagcccagatttagtttcagtgcatcacgtctctgtgttccaagcagcagttaacctcaaggccgcactaacatctctggtgagtttacggcctctggttcctatctactctctgatttaggatattcttcagcagcagattgatcctacattctggcaagtgcagttacatggatcgtaatgtgcaagttcccatgacccctcagtctttctttccagctgatgcacaagttagactctagtcctctccagatgtttcatctcacaatatgaaatccacctttcactggtatctctcacacaaatcagagccagattgccaaacttcttcacctgacctaatcggccaaaaaccagaaagcagtatttgctgttttccaatgatgtggcccaccgtgattaacttccataacacacaaacatgttcctcaaaaagaaaggctaatgctacattctagagaaaatgtattaccccttgatatggtttgactctgtgtcctcacccaaatctcatctcaaattgtaatccccacgtgtcgagggagggaggtgattggatcacttccaatgctgttcttgtgatagtgagtgagttctcatgagatctgattttaaaaatggcagtttcccctgtgctctctctctcttgctgccttgtgaagaaggtgcttacttcccctttgccttctgcataattgtaagtttcctgaggcctccccagccatgtggaacggtgagtcaattaaacccctttcgtttataaattacccagtctcaggtaatatgtttacagcagtgtgagaaaggacaaatgcacccctctcaccctttctttcctgttaaattgtttcaaaactagctttggggcatgttaaaaatgtagatgcgccaggcggataactcatacctgtaatcccagcactttgggagggtgaatcacgaggtcaggagatcgagaccatcctggctaacacagtgaaaccccgtctgtattaaaaatacaaaaagttagccgggtatggtagcatgcacctgtacagtcccagctactcggggggctgaggtgggagaatcacttgaacctagaggcagaggtttcagtgagctgagatcgcaccactgtactccagcctgggcaatggagcaagattccatctcaaaaaaaaaaaaaacaaaaaacaaacaaacaaacaaacaaaaaaaacctgcctgggcctcaagtgcagacctattaaattaaaatttctgggaatggggcttacagactcttgtttttttataagcagccagatagttctgtgcattgaagtttgagaagttatttggggtaggttttctctgagatgcctttctgccctgatattttgtggttctagaagcattcaaagaaaactgtcaatgcacaccccaaaggcacacccatgggtctcctgcagcactggccaccattctcagaccattgcaggactgtgcagagggagtgatggacaggggaaaatgggacagggaagagctaagggttggaaatcacaggtctgctttaaacttcagtgcctttacttctggctctgctgtcttagagcaattacatgacctcactaatttcaggttttctaatttccaagacctgcagtgttagatcagttacatgacctcactatttcaggttttctactttcaaaataggagtaaaaacagatacttcccagatggcaggagggtcaaatgaagcaataatggggctgtatatagcagtgtttaactaaaatttgaattatttaactctgtaaatgttagttttcttcccaatttcccgtttgtaaatgatccctggttcgtgggttattttgaagatcaccttagatgtatatgagagagactctctatggatgacgtcgtgaagagcagagaccctgaatccctttacctgtcggggaagagggacagacaaggccaccagttcaatctgagaaaagggcagtgtggtccactgaatagtggccccccaggacctccaccatctggtccctggaacctgtgatatggtgacttggaaggcaaaagggattctgcagatgtgattaagaactttgagttggggagattatcttgggccatccaggcgggccctaaatgtaatcataaattttcctataagagaaaggcacaggggacttgatgacagtagggaaaggcagtgtgatgacacagtcggggggaaggtgatgtgatgcaaggaaggggccaggagccacgggacgcaggcggctctggaagctgaaaaggcaaggaagcgattctccctagagcctcagttagaaccagccctgccctgcagacacctcggttttgttcccataagactcagtttagacttctgaccaccagaactatacattcccactgtttgaagccaccgagttcgtggtaacttttacagtagccacaggagaggaatgcacgtatatgtaaaagcaacactattgctaagaaagtaaggagcacgttttcataatttacagatgacaagtatctgaaatttcaagggtagtttgaactcacatatttcccccaccagcactttcagggcactcactcagtgcctggccttgtgcagctccgtatcactctgacaacctaaagtttaggctgctgcagccactttgccccacctgaagcatctcaggggtgggggcttgggatgctaaattcttctccatgctgcaggcccagggtgcactcaagctggcaccgtgttccccagagctggtctcagtatctccagagtgggcgtcctggaatcctctcagcctgggaggttctcagggtggctcgagcagccctgtcctcccagagcctgctcaggtcaggagacccatggagggaagggtagggactttcctcccaatccctagaagtcactccacccactatcccaaccttgcttccttttggccccatttgtcctcttgtcctcactttgtctgccagaatcatacttccgacctattgtaaagggtggttttgcagtaaaaatgaagctgatgcaaccagttcaatgcacagaggcccctgagctaagaataggatgagtgtgtaatttctcatccacaccaggacactgctgggcttggcaagctcccactaaagacagcacagtcacgaaccacaggactcaggccagggcagggaaagtaagaggaggcaggcccctctgtcaacctccatcttcccttatccgcaactggtgctgcaggcctgcagctgcagtaggcttccaggagagcccttcagaagacctaagggctgagcagagtcctccgggtggagaagcaggacacaggccttttatttcccttttcttccagaacaccacctggattagagagagccacctttcccaggtggggcatttgcctcctttgactggcccagactcatgattattcaaggctcttgcctgtaactagatcttcctaaggaatcagtgactctctagaacccatcagcagaggatcttctgccatgtacactgttatcacatctcttttagccatccatgaagtttctattttccaagagagatgcccaaagcctccaagccacttgcagggcagtcaggaatcacacactttggatcctattacagagcaagccttccttaatgcagaacacccctttcccctgcccagcttttcgggttcttttgtgatgaccttcccactctacctcctctcaggtgggcagataacactggatacgcagtgacaattttgaatttcaaataaacaacttaagttttttagtttctttctttttaaaaaatacctattgccctaccttttcccaagcccctccaccaaatctgaagaacacagtttccagaaccctatcacaattttatcatatcaaaaatacacacttaaaggctttttaaatttattgacgtgtgaagtagttaaagtggcaattatataattacacaataatttggtggagatgatatttcaaattataagatgcataaaggaaaggtaataaaagggtcttaggctaaaggccttcaaatttgtgatatacaaagagcacagaccacaaccatgaagtccaggagggccgggtcttgcacttgtagaaagtgcacaatcaggctgggcgtggtggctcacacctttgggagactgaggtgggcagatcacctgaggtcaggagtttgagaccagcctggccaacatggtgaaaccccatctgtactaaaagtacaaaaaatttgctgggcgtggtggtgggcacctgaaatcccagctactcaggaggctgaggcaggagaatcatttgaacctgggaggcagaggttgcagtgagccgagatcacgccactatgctccagcctgggtgacagagtgagactctgtctcaaaaagaaagaaagaaaggaagtgcacgttcagatgatgtctcctcccggcctcacactctcaggaaggaaaaacagaacagctgcgtagatcccacggtctcttcctgaagcttccctaactctagcaccagttccagatgggacagcccgtaggctgctcaggcagtgtgtcaaaggctcacctgatgtgccaaggctttctggcttggaagcccctttccgtgccattttgttaaaaatctgtaaacagaaatttaaagtaaattttacctatttattattttgttttatgctaatatgcatgtgaagttaacaattttggggccgttctatgaacataccagtggtaaatacccattataatgtctctttctgttttctgaaaaatgttctttcaatgcagataaatagtcattgaaaatcagtagaatgtgtgtcttttggtcaaacagcaggagagctgggaagggaagttgaaaggcctgggtaattttcatttgtcagtagtgaaatcatcagattaatgaatgaagaatgcatgatttccaccttcatgaagtcactgctagtcttaaccagacaccataaaaaaatgcaaggatgtcctgagctggaaagttaaaatcctgagtgttccagaatcatagactttaaatcctaaggtttaatcctgacattatgccatcaggagcctggtggccaggtaaggtggaaaatgtaaactattttaccaatttcaaaagagctctggaaattagcctatgaatcctataagtgaaaacgtcctccagccaaagacctcaggatcaggcctatagttgaacgagttggatttactatttgttggagggagagagactacacgcagggcacaccagcgggaactgtggggtgtctcaggcagagggggtttgccaggactcattacagaactggggcatgttgggtgatctggggagagcgttcaaggaagtggggctttgctccagatttggttggtgtttggaagaaggggatgctatgcgatgcgtgggttaatcttacctggaagaaggcagaccagagccaggcagcaggcttttaactataaagcagcagcactcactagcatgagctgggagagggggatattaagtcacttttatggtttgaaccatgttcttgccttgtctgtgttcagacctaatgacataatggtcttgttctttttttttttttttttttgagacagagtctcgctctgtcacccaagctggagtgcagtagcatgatctcggctcactgcaagctccacctcccaggttcacgccattctcctgcctcagcctcccaagtagctgggactacaggcacccgccaccgcgcccgactaatttttttgtaattttagtagagacggggtttcaccatgttagctaggatggtctcgatcgcctgaccttgtgatccacccgcctcggcctcccaaagtgctgggattacaggtgtgaaccaccgcgcctggccagtcttgttcttgtcttattccgtcacactcaccaagtggcttccctgaccgttcctgttcagtgaactgtttatgttcatcaggagagaccaaggcccagctgtgggcaccgggccagctcctgcatattaggggccacctttgtcttcttagagcaataataactgatgaacaccaggactaagttagcactgtgtgttcttgtttactgtgggattttactgaataatatttcattacatttctttctccagaaatgctgggaaggaataatttggtggagacaatagttcaaattataggatgcataaaggaaaggtaataaaagggtcttgggctaaaggcattcaggtctcgccgtattcaagtgtgcaatgatgtgttgtagccactgagccaaatcctgggagaccacaagaggctgattgtgtctgtccccatcagtatccaggaaactcactttccccaaacacacctacagcgaggtagttccctaagttaggcagcctctatccacaagccgcacctgcatctctccagtacctgaacacttccttcattccacaagcatttccagacagcccaccttcccctcacactgcatccttctcctcagggacacagaaaccccctctcactgctggtcccaattagatgggcaggcccctccctgctgctcaaagcacaaccagaaaccaggctcagaggcaaccagaactccgaaaggtgttcagaggaaggcgggctggttttgggaccccagggggagaaggaaggcacagcaacagggtgctttatggccccaagaccaacagaaggtgaccccagcctagcacccatggcagccagctaggcttgctcccgctctgatggaacagggccctctggcaataccaggccagcctgacgccacctgacggaggagggacctgaagccctgtccgcataagtggccccagggtggctcccctccttgtgtactgacagcccctcctccccacccagaaatatctggttggtgggcacctgcaggggatccaagcctcttcttcagacagcctgagccttgggccccactgggagacactcagggcagagcctggggaaactccgtctgcccctcagcctgcatcaggagggatcctgagagccacaaggacccccgagaaaccaagcaggagagaacaacacagcagcgactctggaaattagatgccagtagaaccacagcctgcaagatgggccaggacccatgtgccaaacctaaacaggtcactgccttctaaagcaaaagagtcacaggggacccaggtcacctaacatgacaggcagaacgtccaccaaacaactgaaaactcaccatccttccaagagtgcagagatcaccaccagcatgagcaccacgatcagctgctgccaagacccaactatcagatgttggaattatctgacaagggctctaaagtatctgccattaaaaatgcttcagcaatgacaggttctctcgaaataaatcaaacaatggaaaatctcagccctttcctcactgccccagggctggcaatcacttgacatggttgcctgttacacctgatagccctctttgacttcttttttttttttttttatactttaagttttagggtacatgtgacaatgtgcaggttagttacatatgtatacacgtgacatgctggtgtgctgcacccactaactcgtcatctagcattaggtatatctcccaatgctatccctcccccctccccccaccccacaacagtccccagagtgtgatgttccccttcctgtgtccatgtgttattgttcaattcccacctatgagtgagaatatgcagtgtttggttttttgtccttgcgatagtttactgagaatgatgatttccaatttcatccatgtccctacaaaggacatgaactcatcattttttatggctgcatagtattccatggtgtatatgtgccacattttcttaatccagtctatcattgttggacatttggcttggttccaagtctttgctattgtgaatagtgccacaataaacatatgtgtgcgtgtgtctttatagcagcatgatttatagtcctttgggtatatacccagtaatgggattgctgggtcaaatggtatttctagttctagatctctgaggaatcaccacactgacttccacaatggctgaactggtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagactgtctgttcatgtcctttgcccactttttgatggggttgtttttttcttgtaaatttgttggagttcattgtagattctggatattagccctttgtcagatgagtaggttgcgaaaattttctcccatattgtgggttgcctgttcactctaatggtagtttcttttgctgtgcagaagctctttagtttaattagatcccatttgtctattttggcttttgttgccattgcttttggtgttttagacatgaagtccttgcctgtgcctatgtcctgaatggtaatgcctaggttttcttctagggtttttatgggtttaggtctaacgtttaagtctttaatgcatcttgaattgatttttgtataaggtataaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagcgtgatgcctccagctttgttcttttggcttaggattgacctggcgatgcaggctcttttttggttccatatgaactttaaagtagttttttccaattctgtgaagaaagtcattggtagcttgatggggatggcattgaatctataaattaccttgggcagtgtggccattttcacgatattgattcttcctacccatgagcatggaatgttcttccatttgtttgtatcctcttttatttccttaagcagtggtttgtagttctccttgaagaggtccttcacgtcccttgtaaggtggattcctaggtattttattctctttgaagcaattgcgaatgggagttcactcatgatttggctctctgtttgtctgttattggtgtataagaatgcttgtgatttttgtacattgattttgtatcctgagactttgttgaagttgcttatcagcttaaggagatttttggctgagacaatggggttatctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaatttattgagagtttttagcatgaagggttgttgaattttgtcaaaggccttttctgcatctattgagataatcatgtggtttttgtctttggttctgtttatatgctggattacatttattgatttgcgtatattgaaccagccttgcatcccagggatgaagcccacttgatcatggtggataagctttttgatgtgctgctggattccgtttgccagtattttattgaggatttttgcatcgatgttcatcagggatattggtctaaaattctcttttttggttgtgtctctgcccggctttggtatcaggatgatgctggcctcataaaatgagttagggaggattccctctttttctattgattggaatagtttcagaaggaatggtatcagttcatccttgtacctctggtagaattcggctgtgaatccatctggtcctggactctttttggttggtaagctattgattattgccacaatttcagctcctgttattggtctattcagagattcaacttcttcctggtttagtcttgggagagtgtatgtgtcgaggaatttatccatttcttctagattttctagtttaattgcgtagaggtgcttgtagtattctctgatggtagtttgtatttctgtgggatcggtggtgatatcccctttatcattttttattgcgtctatttgattctctctttttttctttattagtcttgctagcggtctatcaattttgttgattctttcaaaaaaccagctcctggattcattaatgttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctgtacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcggttttgagtgagattcttaatcctgagttctagtttgattgcactgtgctctgagagacagtttgttataatttctgttcttttacatttgctgaagagagctttacttccaaatatgtggtcaattttggaataggtgtggtgtggtgctgaaaaaaatgtatattctgttgatttggggtggagagttttgtagatgtctattaggtctgcttggtggagagctgagttgaattcctgggtatgcttgttgactttctgtctcgttgatctgtctaatgttgacagtggggtgttaaagtctcccattattaatgtgtgggagtctaagtctctttgtacgtcactcaggacttgctttatgaatctgggtgctcctgtattgggtgcatatatatttaggatagttagctcttcttgttgaattgatccctttaccattgtgtaatggccttctttgtctcttttgatctttgttggtttaaagtctgttttatcagagactaggattgcaacccctgcctttttttgttttccacttgcttggtagatcttcctccatccttttattttgagcctatgtgtgtctctgcatgtgaggtgggtttcctgaatacaacacactgatggatcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctcgatggtctttacattttggcatgattttgcagcggctggtaccagttgttcctttccatgtttagtgcttccttcaggagctcttttagggcaggcctggtggtgacaaaatctctcagcatttgcttgtctgtaaaggattttatttctccttcacttatgaagcttagtttggctggatatgaaattctgggttgaaaattcttttctttgagaatgttgaatattggcccgcactctcttctggcttgcagtttctgccgagagatccgctgttagtctgatgggcttcgctttgtgggtaacccgacctttctctctggctgcccttaacattttttccttcatttcaactttggtgaatctgacaattatgtgtcttggaggtgctcttctcgaggagtatctttgtggtgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgttcatttctttttattcttttttctctaaacttcccttctcgcttcatttcattcatttcatcttccatcgctgataccctttcttccagttgattgcatcggctcctgaggcttctgcattcttcacgtaattctcgagtcttggctttcagctccatctgctcctttaagcagatgtattggttctgtattggttctctgtattggttattctagttatacattcgtctaaatttttttcaaagtttttaacttctttgccttcggtttgaatttcctcctgtagctcgtagtttgatcgtctgaagctttcttctcccaactcgtcaaagtcattctctgtccagctttgttccattgctggtgaggaactgcgatcctttggaggaggagaggtgctctgctttttagagtttcccgtttttctgctctgttttttccccatctttgtggttttatctacttttggtctttgatgatggtgatgtacagatgggttttggtgtggatgtcctttctgtttgttagctttccttctaacagacaggaccctcagctgcaggtctgttggagtttgctagaggtccactccagaccctgtttgcctgggtatcagcagcggtgtctgcagaacagtggttttcgtgaaccgcgaatgctgctgtctgatcgttcctctggaagttttgtctcagaggagtacccggccgtgtgaggtgtcagtctgcccctacttgggggtgcctcccagttaggctgctcgggggtcaggggtcagggacccacttgaggaggcagtctgcccgttctcagatctccagctgtgtgctgggagaaccactgctgtcctcaaagctgtcagacagggacatttaagtctgcagaggttactgctgtctttttgtttgtctgtgccctgcccccagaggtgtagcctacagaggcaggcaggcaggcctccttgagctgtggtgggctccacccaattggagcttcctggctgctttgtttacctaagcgagcctgggcaatggcgggcgcccctcccctagcctcgctgccgccttgcagtttgatctcagactgctgtgctagcaatcagcgagactctgtgggcgtaggaccctccaagccaggtgcaggatataatctcctggtgcgccgttttttaagcccgtcggaaaagcgcagtattcgggtgggagtgacccgattttccaggtgctgtctgtcacccctttctttgactaggaaagggaactccttgaccccttgtgcttcctgagtgaggcaatgcctcgccctgcttcggctcgcgcacggcgcactgcacccactgtcctgcgcccactgtctggcactccctagtgagatgaacccagtacctcagatggaaatgcagaaatcacctgtcttctgcgtcgctcacgctgggagctgtagaccggagctgttcctattcggccatcttggttccagaaaaaaagtctttgacttcttttaggggcgggtgcctttgcctgtgtaaccgctgttcataggaaagtgtccccattcacatgactccagtggtttctgccacccgtctgcaccgattgagtgactgaggggctctgcagcgctagcaaacattcacctggggagatagagaagatgctttagatcatactctcctggaaaatgccttgaaaccctctttcaacatttcttcctcctagtccttctgtcccaggctttgagcaggttattccctcatcagccacgtcctgtcggctgccattttccatctcatatctgacctataaatcacatcctacatctcaccttaagactggagggagatccagctcccactgccacacctggtcagcctcccagcatatgggactcaacaaagtttagggcagaagtggaaagaatatgctgtagctcccaattctttttccagaatctaaaaacaactgaattataccactctctggcccagagccttcagtcgcccctactgctcttagggaaagcactagggaatcccgaagacccccatctcccatcccagacagtgccttctcccaccctcactcctcctgcccaccgccaccctgcccaccctggccctctctggtgttcctctcatgcatacctctcaaggtgcaccaggcggctgcctctgggtacttgcccagccctgtcccctctgctcccctctcgcaggccatcccaccacactcgtcccacctggcttgtgtcaatgttccattactgttcaccggctgcccacgcacctccagctccacatcgtgagtatttctcccccttctcatctcatgtcctaaaagcattcaacaaatatgtactcagtaaacggtctctgctgctttccatgtgtaatgacccctccctaatgacctcaccagatgcctcctggacccactgccaaagcccctgtatttatttatttattttttgagacatggtctcgctctgttgcccaggctggagtgcaatggcacaatcttggctcacagcaacctccgcctcttgggttcaagtgattctcctgcctcagcctcccaagtagctgggattacagggatgcaccacaatgcctggctaatttttgtatttttagtagagatggggtttttctgtgttgtccaggctggtctcggactcctgacctcaggtgatctgcccgcctcagcctcccaaagtgatgggattacaggcgtgagccactgtgcccggcctagcccctgtgtttctgagctgtgctttttggtatttgggtcctggtaaatatcacttaggaagagacaactgacaatgtctttctaaactttcctttttctcaccagagaatgtgttgctagacgtcattgtcatggtggcaggaggaatttgttaaacttcaaaggaatgcctgtttgtcataaagcctttaaaacaagaagatggcatctcctatgtgggaggagtgaggtttgatcctgcggaaaataaacttagctgacattttcgagtgcgtcttgtgttctgggctgtccttgcgacagtgtcttggcaggtagtactatagtcactcctttaacgtggggacacccgagtttggataacgtgagcagtgtgctggaggtcagtcggcagggggcagagttggatttgaaggtgaggtcgtgtttgtggggccactgtttttaatcacggtactagaggcaccacagagagtgtagagaaaacagaaccgcaaggcctgagtgccttaaagagaggttttcagaatcaggacccagcatgcttattcttgctgcagtgccttaacacgctaaacagcgcttaaccacgctaaaacatcccatgggaaactgtgactgcaaggcccgggggatgttccttctcagcccatgccctgcccatgccccaagtaaaagcagttttagggaccactagtgtcccaggaatcatggtattaaagagttgttgggtgtggtggctcatgcctataatcccagctgctttggaggctgaggcaggagagtcgctggaacccaggaggcagaggctgcagtgagccgagatcgcgccattgcactccagcctggacaacaagagccaaactccaattcaaaaaaaaaaaaagttaacctttcaaagcaagatggttttagccataaattttcatagcaacagaggacagcacataccagtgacggaaccgatactttgaatcaagccagccagaggggtctacacccccttccactgcagacaccaaaacacagggtgccattctccattccctgccatttacaaagaagaatggacaaagtaagtttgaggttaacgaaagcagcctcaggatgttgagttcctagtctcagttcaaacagctatttgtgtgaggctgggcaagtcgctggggtgggcctcaatcccctcatctgattttacctgaggcgccaccaactctaggaagtctcccatgattgtctaaggctgggatccctccctgtgtggcccttactctctttttacctaattcccttcctaagaacgagctccttccagctaagataagctttctcatgactgcaccccctgtgtctggcagaggggacagcacctgacagatgcctgccttggaggctggggctgccacaacaaagaaccacagcctgggggcttaaacacagacgtgcatttcctcacagtgctggaggctggaagtccaagatcaaggtgggcaaggctggcttctcctgcagcctctctcttcggcttgtagatggctgtcttccctgtgcctcagacgatcacccctctgactgtgtctgtatcctaacctcatcttcttataaggacaccagtcagaatggattaaggttcaccctcatggcctgattttaactcaattacctctttaaaggccctctccaaataagatcacagtctgaggtacggtggttgggcttcaacatataaatttgaagaatcttaattcagaccacaacggggtctcacatgtctcaggtgaatggactgaatctcagcctgcagttcaatgggatcacatccatgtgaatctgaattgcagctgtgggttgacctcagccagttggctttggctctcctctgcccagttatttccaggagtctggaagaatctcaggagagctcagggaacctggaacaaacacctactgctggcccccactgctgccactcctgctccctcctgatggcagggtccctgtctcccccagtcacagacacgcggatgagcccccatctgcctggctgacccactgcctcctgagcccaagtctctttggctgaggccccagtacacaccaacaccattttcaaaatgactccttcacaatttctctttaaggccagacaccaaagtcccccagacctgtctctggaacaaatactcttatcttttgtacttgaactaacctttaaaaaaaaaaaagcttggaacctgatgccatagacgagctctgagcttctgtatatttggaaattctgaatctaattgaatagcatgaacttgtcttttccacaaaggatttgaggcactgtgtttttaagtgactaagcccacgtccctctccagacaccacctggggcttggcaatgaggatgctggcggggtttaatatggtcacatgggagccagagaaccaacaaggttgaccagggcacagggggcatgctgaagtatggctgggactgcagcaaattctaattccaagtggatggtaatttcttgagcattatgatgtttgaaaagtacaacagaagtctatattgtaatgtagtgccttcttatccacagggatatgttccaagacccacagtagatgcttgaaaccttgggtagtagtgaaccctacatatgttttttctctgatatatacatacctatgataaaatttaatgtataaattaggcacagtaagaaattaacagcacttactagcaataaaataggacaatcataaccatatgctgtaatgaaagttatgtgaatgtggtctctgtcacaaaacatcttattgtcttcgcctattttctgactgtggttgaccacagataactgaagccacagaaagaaacaccacaggacatgtgtggtggctcacgcctgtaatcccagcactttgggaggctgagctgggcagatcatctgaggtcaggagttcgagaccagcctggccaacatggtgaaaccccagctctactaaaaatataaaaattagctgggcgtggtagcaggcgcctgtagtcccagctacttgggaggctgaggcaggagaatggcgtgaacttgggaggcagagcttgcagtgagccgagatcgcgccactgcactccagcctgggtgacggagcaagactctgtctaaaaaaaaagaaaagaaagcaacgccacagatgggggtgactgtatggtaattaccaaaatgtgtaggagaaaaacatactcactttaaccctgacatattgatttcaccaagactatctttatcttaaatgacagcttaaaataatgtgtttgaaaaacaattacactattcatattaatacaaagatactaaatggcgaattcttggccgttttcatttaccacagaaagaaaagggggcaaatatagttggaaaaagattaaactctgtagcttcataaggtccttcaatgtaaagatgaatagcttcaacatgaagtgaaaagcatctgccacaatcttctaaaattactgggaatataatttaccagcagccttggtgctgagacataacacactctctctccattgttacccattgccctgaatatgtggtcagtgactatcaacgcgttgcgagtggaggaaggcaggatcagagatatcgctgcccaaaaaagcaacaatagcaaacagcagcagcaacacagaatgatggagcctcctgccacactcttcaaagcgctgcagccaggaggacacagagaagaaggtggtgtgggcctgcaaaggacagactctgaatcagtgcgacccaccccgcgtgtccctccaacccaaatagcggatccctctccccaccctacgctgccagtctcgagtgaggctcattgagaagggaagttgtaagttggagggaaaaagttttaagagagcccatgagtgcagaagtcccgcctcccactaaggatctcagcagatgcaggaaagtcacaggcaggaggtcttcaggtgtcttccctatgggcaggaaggaaaggggatgtgactataaccaaattcctgctcccaccagccctccaactaccagccctaacagccaaatccatggacattttatctgtcctgactggaggttgaagggtgtaaggagagaggttgggaaatttcaccgggagtacgcggctaactgagaaagctgaataagagttcactcaccccaaagacccagaatttcatgaattagagcaataaataatgatatagatctccttccagggtaatgcctaagatgtattggagcaccaacagaccaacatcaacagcaacaaagtaaagacaaaaacgcccaggctgtccatcctaggggctggccttcctctcagaaccccaggccaggaaagcaggaagaagggggagcacagagtctgaaaggggctgagacctgctttttcagaggaatttaaagatccacatggagctgcccaaattaagcaaaagtaagagtgaaataaatggcaaggcattcctgcaaatgtactgcaggggaacagtgaacacagggtggaccatggtctgtaaagaaagacaaagatttcattctgcagcaaaatatataactgaatccatgcaagaaagttctccaaaatgttgtgtaagaagttagtaagaaatcgatttcaataaaaaagagctaaaagatagaaaagcaaaatgaaaggtaaattgcagagttttggaaacaaattgaagagcaaaaactcatttcagaacgggaagaaaaaaaaaaaaacctacccgaactgtaaatagcaggaaacagaatagacaatgccaaaaataacaaagctaccatcatagaggaagaatttcagatctccaaagggaataagaggaataaaacacatcattgcatattcaagccaaaatgaggaaaaagaaggaaaattcattttgcataaataaatataccatgtatgtgatggtaggaaattaatttcagaaagtaaatgttataactcatgaatttgtaaaaataacaaagataattgcactatgaaaattaggtaaaagggaagatcaccacaaaatgaatgaattgcccatcctattaaacatctttcaattttctctcaatagtagtcaacagatactcttctgaattgataaatattaaagcatatcacagagtgttgtataaggaacctgcagaaaacctaaaaacaaaaagataactaataatatattggggtttgaagtgagaagtggagaattaatagaaactgtcaggttgataaatcatgaactataggttgaattatgtaaaattatataggtaaccacttaaacacataaaagcaataaatctttcattttaacaaaaggattgcacataatcagaaggaggggggaaataaaaaaatccaaaagggaatgcaaaagaaatattaattacagatattgaaaaaaatattaaaccaaatatatcagcaatatgtattaaaaatataagtgcagatccaagataaataaacctaaaacaaagtgcctcaaaaaggttaaacataaaattgagtataaaataataagaaatacatattggtctgtgtctccagtttctgacacagagctcctaatacccttgtaatttcctgagtgatgggggtactgggagcatcttttgttctaatattggttgggagcatctttgactgggttcctggtacagagcttccaatcccttggaatttcctgggtgataggagcatcttttgttctaatgaacgactcttggtggaatcctagatgagggctggtcaccagaaagaccaagccatggttagaagcttggaactttcagccccacaccccatcctctagggaggaaagaggagttggagattgaatcaataatcaatcatgcctacatgatgaagcctccttaaaaattcctaagtacaggtgcgggagcttcagggttggggaacacgtggtggtgctcctggagaggccatggcagctccatacccacccccaccatatcttttcctgtatttctctcccatttggctgtattctttataataagtggataaacatagtagtgttgccctgggttctctgcgctgttccaccaaatgactggacctaagaaggggggcgtgggaacctccgatttatagccaagttggacagaagctgtgggtgacctgcagacccaccacttacaactggcatctggagcagggcagtcctgggaattgagcccctcccctgtggggctggctctaactccagttagtgtcagagttgagctgaacggtaggacacccagctggtgctggcgaatgggtgggatttttccccacacatgtggagacgggaggtgttgtgtgagtgtaagaatgaacgagagaggcatctcagcataagaaatcagtggggctgattttaaaagcagacaaatgtgaattcaaggttaagtattgaaaatagaatgaaaatccggtaaatcgttaaacatcctgtggtaaatggaaggatgattgaaagaggaatgctgctgacagggagcgtggccccagccaggccagtgagcaaagccaggggtggaactcccacacacccgcccaggtcgttctcagagagggacccattcacaggcactgatcatacaaacccctcagaaacacctcagcacattataaatattagaaatagaacaaaaggcattttgcttaaagcataaggtaatgtaactagaaattaatttttaagttaaaaaatgtggaaattttaaaacactcaacaaagctcagttcgggctggtctgagtgcagtggggtgtacaaggaattgattacaagcagttacaggtttctttgctccttttccatttccactgctgcttcacttcactagcctttatttaaaaagtcagcttgaagaaggtacaacaattcaacttatagaatatccagaaaatacaaatgaaaacattgcatattaagacgtatggactgctgttaaagctttgatcagaataaaatgcagagccaaaaatacttatctgattaaataagaataattggaaacacatgaattaggcatctattgaataacttagaacaacaacaacaaaataaaagtagaagagaactggctgggcacggtggctcacgctggtagtcccagcactttgggaggctgaggcgggtagatcaactgaggtcaggagtttgagaccagcctggccaacatggtgcaacctctactaaaaatacaaaaaaaaaaaaaaaaaaaaaaaattaaccgggagtggtagtgggtgcctgtaatcccagctactcaggaggctaaggcaggagaattgcttgaactcgggaggtggaggttgcagtgagccaagatgacgccattgcactccagcctgggtgacagtgcgagacttcctctcaaaaaaaaaaaaaaaaaaaaagtaaaaggatcatggctgaatcctgaggatatcttatttcatgtaatgtgaaataagtcagtcacaaaaggacaaatactatatgaatccacttgtatcaggtacctagccaaatttataaagaccaaaaggaggccaggtgtggtggctcacgcctgtaattccagcactttgggaggaggaggcaggcagatcacttgaggccaggagtttgagaccagcctggccaacgtggtgaaaccccatctctactaaaaatatataaaattagctgggattggtggtgtgctctggtaatcccagcaactctggaggccgaggcatgagaatcgcttggacccaggaggcagaggttgcagtgagcagagattgcaccactgcactctagcctgggtgataaaatgagactctgtctcaaaaaaagaaaaaaaaaaaaaaaggaccaaaacaagagtggttgatgtttgatagagacagggtttcaatttgggaagatgaaaagagttctgggaatatgtggttgtgaagactgtacaacaatgtgactgtatttaatgacactgaatggtacacttaaaactggttaaaatgataaattttatgttatgtatattttacgaaaatttaaaaatatacaataatttttaaaaagtaaaatagaatgaaaatattaaagataaaagcagaaaactaaaaattagaaaacatacctgcagaatttgttgatgggaagtatttatcaaaggtgaacacacagaactctaacacagcagcagaggaaatggtaggaaggccattggcagaaaaaaaggaaatttagaaagcagtgcaaaatgttacacgtgacggtggagagaagacaagaaagagtgtggaactgcagcactgcagaaaggtggcattcccgaagcgggctgtgtgcaaacacagggggcgtctcgtcacaaagagtttgagaaagatagaatctgtgggccgcatccccaggggccataactttgagaccccttccccaactcaggacaagctatggcattagaaggtcaaacgcatatgaagtaaacagtaattacaaaaggagctatccatggtgaggtcagaaacactgatagacggaaggtctagggaggttgggaagggtttgtaccacataaaaaatgaaggaatgagaaaaagttaaattatgtaagagttccttcctgaggcgtgcacctccagggggctctgcttaaagcttctgtcagtcttttctccaactcactggggtccccgtgagtgcaatgaccagctacatctaacccaccatgctgccccgactagtttgtcccacaggctcccagggcccagaggaagggctgaaccgtgtgttgggcccagcactggctggagaagcacctgcaacaactgtggcttctgctgtgctggcccactgctgtcacctgggagggctgggtcaacgcagggacccccaagaccctgcagacaggtcctcggactgcaaagtctaagggtccgatgtcttaaaaatataaaccggtaaaactcatggcaagctaaatcaataggcacgggagaaaggagaaatgcacacaattacaaacggaaaaaggagaaaaagccacaaatacagaggaaagaaaacacctgaagtgcatatattacaaaactacgcaactatgttgaaaagtggatggaattaattttatttttaaaaatgtcattaaaatggactctagaagggctcgaggacctaacttgcctgatgagcaaaatccagaaatataccacggcaggcccagacagccccagctagttcttctacacttaagcagaaaataatccaaaaccaatagatgattgtagaatatagaggtttttgttttataatatttcttcctttaagtcagcataaagttaaatctggacaaaaaacacataaaagcaagatgtagaatgatgaatcttaattataaatattgataaccaaagtcatgatactaataagtaaagaacatctcaggaatacactaatgatttggtcttaagtattctattaatataattaaacatactactagagcaaaggaaaagaccttctgataatccctctggacactgagaaggctttgacaaaaatctaacatctacattttccccagagagtcttaatagtttgagaacacacagatacttttttattatggcaaggaaaatacatgtcttcatacaagttaaacgctgagacattaaaacgtcccactgatgtcacgaacaagataagcatgccacctgaatcactgtgactcaacactgatctcaaatcaactagatacaagaaagaaataagagacacattggaaaggagaagtcaaaagtataccttagaaacaagtaggaatcacaatttgtggttgattataacattcatacataaaaaccaactactttcttatacaatgggataaaatagaaaataaagtggaataaatcattccattgaaaatgatagccaaatgataaaacatctagaaataaactataaattcaaagcaccttagtgaacaaaatcataaaacactactaagttacataaaattagacttaaacacaagatttcatgcttttgaataggaagactcaatctgtaaattcattgtgactctaattgaaaaaagattcatatgagagagagattcagagttgatgggagtgttgacttgaaaatactgatattagtatgaataatgctttagaaatgaaaggcattcatagagataaatagaacagaaacagaaccaaacacttaaagaaatttagtttacaaataaggctgcattttgaacaactggggaaaacactatgactgtattttagaaatgcattattacatatttattgatactgctgaccaccatttcgaggaaaaagtatggatttttccctcatgtcctgcaacaaatgaattccagggagtctgaagatgtgaaggtaaaccaataaaaccataaagtttcagaagaaaatgcgagtaagtctatttataatctcagaatgaggaaggcttttaaaaactggaaacaaatcccacgatcgacaaagaaaaatactcacaaattgacaacataaaaatttaaactctatgccaataaataaggaaatcaataaataacatcgaaagacaaatgataaaaatattttaaagacataagacaaaaatgtcccaaagtgcatgagcaaattaagaaaaagccaaataacccaattaggaactgggtaaaatatataaatgtatcaaaattaaaactacaaaaaaattttaaaagatgtcccattttatacacaaaataaaccaaaatcagaataatattcgtaaatatcatgtttcaccaattatattgggaaaaacattaagtttgaaaatacccagtgctattatagaaagctgagaaattgggccttttattgtactcttgatggagttacatccttcgatcagtttctagaagataatctggcaatagctatcaaaattttaaatacatgtagccttaaacccagcaattccatttctaagttggaatttataccgttttagtcacaaaactatgtcaagatgtatgtacaagtatgccaattatagatttgtatataaaaataaaaactggaagtatccatatgttcaccaataaaaggctattcaaataaatgatagtccgctgagataatggaatgctaagcagctactaggaggaatgaggtagatctttatatgttattatgggacgacctctaagacaaaacaccacatgaagaatgcaaggtgcagcgcccttcacagagcgttagtgctggaaagggaaggtctctctccataacccccgtccctccttctttggcctcttatcttcttttcttcctttctagaaatgcccttagaagctcattagtggtcccctctgagagagaaaacaggcagtatgggagactgttgtttttaaccactcatacttttctaactatgtgcacatctattccttattattactttattaaaggacagagtagttatttgagagtccaaaatatgcacaacttgtttgcattttgtgttcctgtataaaatacaaaaccaaaaaggtttctttttaaagcaaaaatgtgggagggatcaattttgggataatgataagaaatga
